United States Patent 12,508,308 (INFLUENZA mRNA VACCINES) - sequence listing, part 28

SEQ ID NO: 104297 - RNA, 1701 nt, Artificial Sequence
  derived and/or modified sequence opt2 from hemagglutinin__InfluenzaA__AIW60691
augaagaccaucaucgcccucuccuacauccucugccucgucuucgcccagaagcuccccggcaacgacaacuccaccgccacccucugccucggccaccacgccguccccaacggcacccucgucaaggccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagacccgccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104298 - RNA, 1701 nt, Artificial Sequence
  derived and/or modified sequence opt2 from hemagglutinin__InfluenzaA__AIW60692
augaagaccaucaucgcccucuccuacauccucugccucgucuucgcccagaagcuccccggcaacgacaacuccaccgccacccucugccucggccaccacgccguccccaacggcacccucgucaaggccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104299 - RNA, 1701 nt, Artificial Sequence
  derived and/or modified sequence opt2 from hemagglutinin__InfluenzaA__AIW60693
augaagaccaucaucgcccucuccuacauccucugccucgucuucgcccagaagcuccccggcaacgacaacuccaccgccacccucugccucggccaccacgccguccucaacggcacccucgucaagaccaucaccaacgaccagaucgaggucaccaacgccaccgagcucguccagaacuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaccuccaucuacgcccaggccuccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104300 - RNA, 1701 nt, Artificial Sequence
  derived and/or modified sequence opt2 from hemagglutinin__InfluenzaA__AIW60694
augaagaccaucaucgcccucuccuacauccucugccucgucuucgcccagaagcuccccggcaacgacaacuccaccgccacccucugccucggccaccacgccguccucaacggcacccucgucaagaccaucaccaacgaccagaucgaggucaccaacgccaccgagcucguccagaacuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaccucccucuacgcccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104301 - RNA, 1701 nt, Artificial Sequence
  derived and/or modified sequence opt2 from hemagglutinin__InfluenzaA__AIW60695
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaacuacaaguaccccgcccucaacgucaccaugcccaacaacgagaaguucgacaagcucuacaucuggggcguccaccaccccuccaccgacuccgaccagaucuccaucuacgcccaggcccccggccgcgucaccgucuccaccaagcgcucccagcagaccgucauccccaacaucggcucccgccccuggguccgcggcgucuccuccaucaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104302 - RNA, 1701 nt, Artificial Sequence
  derived and/or modified sequence opt2 from hemagglutinin__InfluenzaA__AIW60696
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgaccagaacggcaccuccuccgccugcaagcgccgcuccaacaaguccuucuucucccgccucaacuggcuccaccagcucaaguacaaguaccccgcccucaacgucgccaugcccaacaacgagaaguucgacaagcucuacaucuggggcguccaccaccccuccaccgacuccgaccagaucucccucuacgcccaggcccccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacugcaccggcaaccucaucgccccccgcggcuacuucaagauccgcuccggcaaguccuccaucaugcgcuccgacgccuccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104303 - RNA, 1701 nt, Artificial Sequence
  derived and/or modified sequence opt2 from hemagglutinin__InfluenzaA__AIW60697
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccuccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccgacaccgacuccguccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104304 - RNA, 1701 nt, Artificial Sequence
  derived and/or modified sequence opt2 from hemagglutinin__InfluenzaA__AIW60698
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccggcaccgacuccgaccagaucucccucuacgcccaggccuccggccgcaucaccgucuccaccaagcgcucccagcagaccgucauccccaacaucggcucccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104305 - RNA, 1701 nt, Artificial Sequence
  derived and/or modified sequence opt2 from hemagglutinin__InfluenzaA__AIW60699
augaagaccaucaucgcccucuccuacauccucugccucgucuucgcccagaagcuccccggcaacgacaacuccaccgccacccucugcaucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccgucaccgacaacgaccagaucucccucuacgcccaggccuccggcaagaucaccgucuccaccaagcgcucccagcagaccgucauccccaacaucggcucccgcccccgcguccgcgacauccccucccgcaucuccaucuacuggaccaucgucaagcccggcgacauccuccucaucaaguccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgaggagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104306 - RNA, 1701 nt, Artificial Sequence
  derived and/or modified sequence opt2 from hemagglutinin__InfluenzaA__AIW60700
augaagaccaucaucgcccucuccuacauccucugccucgucuucgcccagaagcuccccggcaacgacaacuccaccgccacccucugcaucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucucccucuacgcccaggccuccggcaagaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgaggagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104307 - RNA, 1701 nt, Artificial Sequence
  derived and/or modified sequence opt2 from hemagglutinin__InfluenzaA__AIW60701
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104308 - RNA, 1701 nt, Artificial Sequence
  derived and/or modified sequence opt2 from hemagglutinin__InfluenzaA__AIW60702
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104309 - RNA, 1701 nt, Artificial Sequence; identical to SEQ ID NO: 104053
  derived and/or modified sequence opt2 from hemagglutinin__InfluenzaA__AIZ07211

SEQ ID NO: 104310 - RNA, 1701 nt, Artificial Sequence
  derived and/or modified sequence opt2 from hemagglutinin__InfluenzaA__AIZ07212
augaagaccaucauggcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104311 - RNA, 1683 nt, Artificial Sequence
  derived and/or modified sequence opt2 from hemagglutinin__InfluenzaA__AJD78175
auggagaccgccucccucaucaccauccuccucgucgucaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucggcggccgcgagugguccuacaucgucgagcgccccuccgccgccaacggccucugcuaccccggcaacgucgagaaccucgaggagcuccgcucccucuucuccuccgcccgcuccuaccagcgcauccagaucuuccccgacaccaucuggaacgucuccuacuccggcaccuccaaggccugcuccgacuccuucuaccgcuccaugcgcuggcucacccagaaggacaacaccuaccccauccaggacgcccaguacaccaacaaccagggcaagaacauccucuucauguggggcaucaaccacccccccaccgacaccgcccagaccaaccucuacacccgcaccgacaccaccaccuccgucgccaccgaggagaucaaccgcaccuucaagccccucaucggcccccgcccccucgucaacggccucaugggccgcaucaacuacuacugguccguccucaagcccggccagacccuccgcaucaaguccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucaacgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 104312 - RNA, 1683 nt, Artificial Sequence
  derived and/or modified sequence opt2 from hemagglutinin__InfluenzaA__AJD78187
auggagaccgccucccucaucaccauccuccucgucgucaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacuccggcaccuccaagaccugcuccgacuccuucuaccgcuccaugcgcuggcucacccagaaggacaacgccuaccccauccaggacgcccaguacaccaacaaccagggcaagaacauccucuucauguggggcaucaaccacccccccaccgacaccacccagaccaaccucuacacccgcaccgacaccaccaccuccgucgccaccgaggagaucaaccgcaccuucaagccccucaucggcccccgcccccucgucaacggccucaugggccgcaucaacuacuacugguccguccucaagcccggccagacccuccgcaucaaguccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 104313 - RNA, 1683 nt, Artificial Sequence
  derived and/or modified sequence opt2 from hemagglutinin__InfluenzaA__AJD78199
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccucucccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacgacggcaccuccaccgccugcuccggcuccuucuaccgcuccaugcgcuggcucacccgcaagaacggcgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 104314 - RNA, 1683 nt, Artificial Sequence
  derived and/or modified sequence opt2 from hemagglutinin__InfluenzaA__AJD78211
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccucucccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacgacggcaccuccaccgccugcuccggcuccuucuaccgcuccaugcgcuggcucacccgcaagaacggcgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcucccgccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 104315 - RNA, 1689 nt, Artificial Sequence
  derived and/or modified sequence opt2 from hemagglutinin__InfluenzaA__AJI76401
auggccaucaucuaccucauccuccucuucgccaccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcucccucaacgacuacgaggagcucaagcaccuccucuccuccgucaagcacuucgagaagguccgcauccuccccaaggaccgcuggaccaaccacaccaccaccggcggcuccaaggccugcgccgucuccggcaagcccuccuucuuccgcaacauggucuggcucaccaagaagggccccaacuaccccgucgccaagggcuccuacaacaacaccuccggcgagcagaugcucaucaucuggggcguccaccaccccaucgacgaggccgagcagcgcgcccucuaccagaacgucggcaccuacgucuccgccuccaccuccacccucuacaagcgcuccauccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucaacaaccucgagaagcgccucgagaaccucaacaagcgcauggaggacggcuuccucgacgucuggaccuacaacgccgagcuccucguccucauggagaacgagcgcacccucgacuuccacgacuccaacgucaagaaccucuacgagaagguccgcaugcagcuccgcgacaacguccgcgagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucauggucgccggcaucuccuucuggaugugcuccaacggcucccuccagugccgcaucugcaucuga

SEQ ID NO: 104316 - RNA, 1701 nt, Artificial Sequence; identical to SEQ ID NO: 103577
  derived and/or modified sequence opt2 from hemagglutinin__InfluenzaA__AJI80137

SEQ ID NO: 104317 - RNA, 1701 nt, Artificial Sequence; identical to SEQ ID NO: 103577
  derived and/or modified sequence opt2 from hemagglutinin__InfluenzaA__AJI80149

SEQ ID NO: 104318 - RNA, 1701 nt, Artificial Sequence; identical to SEQ ID NO: 101552
  derived and/or modified sequence opt2 from hemagglutinin__InfluenzaA__AJI80161

SEQ ID NO: 104319 - RNA, 1701 nt, Artificial Sequence
  derived and/or modified sequence opt2 from hemagglutinin__InfluenzaA__AJI80172
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcucccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104320 - RNA, 1701 nt, Artificial Sequence
  derived and/or modified sequence opt2 from hemagglutinin__InfluenzaA__AJI80196
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacaucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgaguuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104321 - RNA, 1701 nt, Artificial Sequence; identical to SEQ ID NO: 104127
  derived and/or modified sequence opt2 from hemagglutinin__InfluenzaA__AJI80208

SEQ ID NO: 104322 - RNA, 1701 nt, Artificial Sequence; identical to SEQ ID NO: 101506
  derived and/or modified sequence opt2 from hemagglutinin__InfluenzaA__AJI80220

SEQ ID NO: 104323 - RNA, 1701 nt, Artificial Sequence; identical to SEQ ID NO: 104319
  derived and/or modified sequence opt2 from hemagglutinin__InfluenzaA__AJI80232

SEQ ID NO: 104324 - RNA, 1701 nt, Artificial Sequence; identical to SEQ ID NO: 101506
  derived and/or modified sequence opt2 from hemagglutinin__InfluenzaA__AJI80244

SEQ ID NO: 104325 - RNA, 1701 nt, Artificial Sequence; identical to SEQ ID NO: 101370
  derived and/or modified sequence opt2 from hemagglutinin__InfluenzaA__AJI80256

SEQ ID NO: 104326 - RNA, 1701 nt, Artificial Sequence; identical to SEQ ID NO: 101506
  derived and/or modified sequence opt2 from hemagglutinin__InfluenzaA__AJI80268

SEQ ID NO: 104327 - RNA, 1701 nt, Artificial Sequence
  derived and/or modified sequence opt2 from hemagglutinin__InfluenzaA__AJI80280
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcaagaucugcgacuccccccaccagauccucgacggcgagaacugcacccucaucgacgcccuccucggcgacccccagugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104328 - RNA, 1701 nt, Artificial Sequence; identical to SEQ ID NO: 104099
  derived and/or modified sequence opt2 from hemagglutinin__InfluenzaA__AJI80292

SEQ ID NO: 104329 - RNA, 1701 nt, Artificial Sequence; identical to SEQ ID NO: 104127
  derived and/or modified sequence opt2 from hemagglutinin__InfluenzaA__AJI80303

SEQ ID NO: 104330 - RNA, 1701 nt, Artificial Sequence; identical to SEQ ID NO: 104099
  derived and/or modified sequence opt2 from hemagglutinin__InfluenzaA__AJI80315

SEQ ID NO: 104331 - RNA, 1701 nt, Artificial Sequence
  derived and/or modified sequence opt2 from hemagglutinin__InfluenzaA__AJI80326
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagaagaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104332 - RNA, 1701 nt, Artificial Sequence
  derived and/or modified sequence opt2 from hemagglutinin__InfluenzaA__AJI80337
augaaggccauccucgucguccuccucuacaccuucgccaccgccaacgccgacacccucugcaucggcuaccacgccaacaacuccaccgacaccgucgacaccguccucgagaagaacgucaccgucacccacuccaucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccaacgccuacgucuucgucggcaccuccaaguacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104333 - RNA, 1701 nt, Artificial Sequence; identical to SEQ ID NO: 101506
  derived and/or modified sequence opt2 from hemagglutinin__InfluenzaA__AJI80348

SEQ ID NO: 104334 - RNA, 1701 nt, Artificial Sequence; identical to SEQ ID NO: 101370
  derived and/or modified sequence opt2 from hemagglutinin__InfluenzaA__AJI80360

SEQ ID NO: 104335 - RNA, 1701 nt, Artificial Sequence; identical to SEQ ID NO: 101370
  derived and/or modified sequence opt2 from hemagglutinin__InfluenzaA__AJI80372

SEQ ID NO: 104336 - RNA, 1701 nt, Artificial Sequence; identical to SEQ ID NO: 101552
  derived and/or modified sequence opt2 from hemagglutinin__InfluenzaA__AJI80384

SEQ ID NO: 104337 - RNA, 1701 nt, Artificial Sequence; identical to SEQ ID NO: 101552
  derived and/or modified sequence opt2 from hemagglutinin__InfluenzaA__AJI80395

SEQ ID NO: 104338 - RNA, 1701 nt, Artificial Sequence; identical to SEQ ID NO: 101552
  derived and/or modified sequence opt2 from hemagglutinin__InfluenzaA__AJI80406

SEQ ID NO: 104339 - RNA, 1701 nt, Artificial Sequence; identical to SEQ ID NO: 101552
  derived and/or modified sequence opt2 from hemagglutinin__InfluenzaA__AJI80417

SEQ ID NO: 104340 - RNA, 1701 nt, Artificial Sequence; identical to SEQ ID NO: 101552
  derived and/or modified sequence opt2 from hemagglutinin__InfluenzaA__AJI80428

SEQ ID NO: 104341 - RNA, 1701 nt, Artificial Sequence; identical to SEQ ID NO: 101506
  derived and/or modified sequence opt2 from hemagglutinin__InfluenzaA__AJI80439

SEQ ID NO: 104342 - RNA, 1701 nt, Artificial Sequence; identical to SEQ ID NO: 101506
  derived and/or modified sequence opt2 from hemagglutinin__InfluenzaA__AJI80462

SEQ ID NO: 104343 - RNA, 1701 nt, Artificial Sequence
  derived and/or modified sequence opt2 from hemagglutinin__InfluenzaA__AJI80474
augaaggccauccucgucguccuccucuacaccuucgccaccgccaacgccgacacccucugcaucggcuaccacgccaacaacuccaccgacaccgucgacaccguccucgagaagaacgucaccgucacccacuccaucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104344 - RNA, 1701 nt, Artificial Sequence; identical to SEQ ID NO: 104343
  derived and/or modified sequence opt2 from hemagglutinin__InfluenzaA__AJI80485

SEQ ID NO: 104345 - RNA, 1701 nt, Artificial Sequence; identical to SEQ ID NO: 101552
  derived and/or modified sequence opt2 from hemagglutinin__InfluenzaA__AJI80496

SEQ ID NO: 104346 - RNA, 1701 nt, Artificial Sequence; identical to SEQ ID NO: 104155
  derived and/or modified sequence opt2 from hemagglutinin__InfluenzaA__AJI80507

SEQ ID NO: 104347 - RNA, 1701 nt, Artificial Sequence; identical to SEQ ID NO: 101552
  derived and/or modified sequence opt2 from hemagglutinin__InfluenzaA__AJI80518

SEQ ID NO: 104348 - RNA, 1701 nt, Artificial Sequence; identical to SEQ ID NO: 99644
  derived and/or modified sequence opt2 from hemagglutinin__InfluenzaA__AJJ98765

SEQ ID NO: 104349 - RNA, 1701 nt, Artificial Sequence
  derived and/or modified sequence opt2 from hemagglutinin__InfluenzaA__AJJ98777
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuucuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104350 - RNA, 1701 nt, Artificial Sequence; identical to SEQ ID NO: 100965
  derived and/or modified sequence opt2 from hemagglutinin__InfluenzaA__AJJ98789

SEQ ID NO: 104351 - RNA, 1701 nt, Artificial Sequence
  derived and/or modified sequence opt2 from hemagglutinin__InfluenzaA__AJJ98801
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcaacaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104352 - RNA, 1701 nt, Artificial Sequence
  derived and/or modified sequence opt2 from hemagglutinin__InfluenzaA__AJJ98813
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucguccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104353 - RNA, 1701 nt, Artificial Sequence
  derived and/or modified sequence opt2 from hemagglutinin__InfluenzaA__AJJ98825
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgccaccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104354 - RNA, 1701 nt, Artificial Sequence
  derived and/or modified sequence opt2 from hemagglutinin__InfluenzaA__AJJ98837
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104355 - RNA, 1701 nt, Artificial Sequence
  derived and/or modified sequence opt2 from hemagglutinin__InfluenzaA__AJJ98849
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgccuccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104356 - RNA, 1701 nt, Artificial Sequence
  derived and/or modified sequence opt2 from hemagglutinin__InfluenzaA__AJJ98861
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104357 - RNA, 1701 nt, Artificial Sequence
  derived and/or modified sequence opt2 from hemagglutinin__InfluenzaA__AJJ98873
augaagaccaucaucgcccucuccuacucccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104358 - RNA, 1701 nt, Artificial Sequence
  derived and/or modified sequence opt2 from hemagglutinin__InfluenzaA__AJJ98885
augaagaccaucaucgcccucuccaacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaaggagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104359 - RNA, 1701 nt, Artificial Sequence
  derived and/or modified sequence opt2 from hemagglutinin__InfluenzaA__AJJ98897
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104360 - RNA, 1701 nt, Artificial Sequence; identical to SEQ ID NO: 103282
  derived and/or modified sequence opt2 from hemagglutinin__InfluenzaA__AJJ98909

SEQ ID NO: 104361 - RNA, 1701 nt, Artificial Sequence
  derived and/or modified sequence opt2 from hemagglutinin__InfluenzaA__AJJ98921
augaagaccaucaucgcccucuccuacauccucugccucgucuucgcccagaagcuccccggcaaggacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucaagcagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104362 - RNA, 1701 nt, Artificial Sequence; identical to SEQ ID NO: 100965
  derived and/or modified sequence opt2 from hemagglutinin__InfluenzaA__AJJ98933

SEQ ID NO: 104363 - RNA, 1701 nt, Artificial Sequence; identical to SEQ ID NO: 98494
  derived and/or modified sequence opt2 from hemagglutinin__InfluenzaA__AJJ98945

SEQ ID NO: 104364 - RNA, 1701 nt, Artificial Sequence
  derived and/or modified sequence opt2 from hemagglutinin__InfluenzaA__AJJ98957
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104365 - RNA, 1701 nt, Artificial Sequence; identical to SEQ ID NO: 93946
  derived and/or modified sequence opt2 from hemagglutinin__InfluenzaA__AJJ98969

SEQ ID NO: 104366 - RNA, 1701 nt, Artificial Sequence
  derived and/or modified sequence opt2 from hemagglutinin__InfluenzaA__AJJ98981
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccacauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104367 - RNA, 1701 nt, Artificial Sequence
  derived and/or modified sequence opt2 from hemagglutinin__InfluenzaA__AJJ98993
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacaacccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104368 - RNA, 1701 nt, Artificial Sequence
  derived and/or modified sequence opt2 from hemagglutinin__InfluenzaA__AJJ99005
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaucggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104369 - RNA, 1701 nt, Artificial Sequence; identical to SEQ ID NO: 94923
  derived and/or modified sequence opt2 from hemagglutinin__InfluenzaA__AJJ99017

SEQ ID NO: 104370 - RNA, 1701 nt, Artificial Sequence
  derived and/or modified sequence opt2 from hemagglutinin__InfluenzaA__AJJ99029
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104371 - RNA, 1701 nt, Artificial Sequence
  derived and/or modified sequence opt2 from hemagglutinin__InfluenzaA__AJJ99041
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccgacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104372 - RNA, 1701 nt, Artificial Sequence; identical to SEQ ID NO: 101370
  derived and/or modified sequence opt2 from hemagglutinin__InfluenzaA__AJJ99053

SEQ ID NO: 104373 - RNA, 1701 nt, Artificial Sequence; identical to SEQ ID NO: 101370
  derived and/or modified sequence opt2 from hemagglutinin__InfluenzaA__AJJ99065

SEQ ID NO: 104374 - RNA, 1701 nt, Artificial Sequence
  derived and/or modified sequence opt2 from hemagglutinin__InfluenzaA__AJJ99089
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcaacaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104375 - RNA, 1701 nt, Artificial Sequence; identical to SEQ ID NO: 101060
  derived and/or modified sequence opt2 from hemagglutinin__InfluenzaA__AJJ99101

SEQ ID NO: 104376 - RNA, 1701 nt, Artificial Sequence; identical to SEQ ID NO: 100965
  derived and/or modified sequence opt2 from hemagglutinin__InfluenzaA__AJJ99113

SEQ ID NO: 104377 - RNA, 1701 nt, Artificial Sequence
  derived and/or modified sequence opt2 from hemagglutinin__InfluenzaA__AJJ99125
augaagaccaucaucgcccucuccuacauccucugcauggucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104378 - RNA, 1701 nt, Artificial Sequence
  derived and/or modified sequence opt2 from hemagglutinin__InfluenzaA__AJJ99137
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgucuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104379 - RNA, 1701 nt, Artificial Sequence
  derived and/or modified sequence opt2 from hemagglutinin__InfluenzaA__AJJ99149
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacaugcccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccaggcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104380 - RNA, 1701 nt, Artificial Sequence
  derived and/or modified sequence opt2 from hemagglutinin__InfluenzaA__AJJ99161
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104381 - RNA, 1701 nt, Artificial Sequence
  derived and/or modified sequence opt2 from hemagglutinin__InfluenzaA__AJJ99173
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104382 - RNA, 1701 nt, Artificial Sequence
  derived and/or modified sequence opt2 from hemagglutinin__InfluenzaA__AJJ99185
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcgccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104383 - RNA, 1701 nt, Artificial Sequence; identical to SEQ ID NO: 100320
  derived and/or modified sequence opt2 from hemagglutinin__InfluenzaA__AJJ99197

SEQ ID NO: 104384 - RNA, 1701 nt, Artificial Sequence
  derived and/or modified sequence opt2 from hemagglutinin__InfluenzaA__AJJ99209
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcaaguccgacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 104385 - RNA, 1701 nt, Artificial Sequence
  derived and/or modified sequence opt2 from hemagglutinin__InfluenzaA__AJJ99221
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104386 - RNA, 1701 nt, Artificial Sequence; identical to SEQ ID NO: 93427
  derived and/or modified sequence opt2 from hemagglutinin__InfluenzaA__AJJ99233

SEQ ID NO: 104387 - RNA, 1701 nt, Artificial Sequence
  derived and/or modified sequence opt2 from hemagglutinin__InfluenzaA__AJJ99244
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104388 - RNA, 1701 nt, Artificial Sequence
  derived and/or modified sequence opt2 from hemagglutinin__InfluenzaA__AJJ99255
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaaccacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaagcucuccaaguccuacaucaacgacaagggcaaggagguccucgucauguggggcauccaccaccccuccaccaccgccgaccagcagucccucuaccagaacgccgacgccuacgucuucgucggcaccucccgcuacuccaaggaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104389 - RNA, 1698 nt, Artificial Sequence
  derived and/or modified sequence opt2 from hemagglutinin__InfluenzaA__AJJ99267
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccgucuccuucuggaugugcuccaacggcucccuccagugccgcgucugcaucuga

SEQ ID NO: 104390 - RNA, 1701 nt, Artificial Sequence; identical to SEQ ID NO: 98562
  derived and/or modified sequence opt2 from hemagglutinin__InfluenzaA__AJJ99278

SEQ ID NO: 104391 - RNA, 1701 nt, Artificial Sequence; identical to SEQ ID NO: 98565
  derived and/or modified sequence opt2 from hemagglutinin__InfluenzaA__AJJ99289

SEQ ID NO: 104392 - RNA, 1698 nt, Artificial Sequence
  derived and/or modified sequence opt2 from hemagglutinin__InfluenzaA__AJJ99301
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagucccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104393 - RNA, 1698 nt, Artificial Sequence
  derived and/or modified sequence opt2 from hemagglutinin__InfluenzaA__AJJ99324
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaaguccggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104394 - RNA, 1701 nt, Artificial Sequence
  derived and/or modified sequence opt2 from hemagglutinin__InfluenzaA__AJJ99335
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccaacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104395 - RNA, 1701 nt, Artificial Sequence; identical to SEQ ID NO: 96297
  derived and/or modified sequence opt2 from hemagglutinin__InfluenzaA__AJJ99357

SEQ ID NO: 104396 - RNA, 1701 nt, Artificial Sequence; identical to SEQ ID NO: 98336
  derived and/or modified sequence opt2 from hemagglutinin__InfluenzaA__AJJ99368

SEQ ID NO: 104397 - RNA, 1701 nt, Artificial Sequence; identical to SEQ ID NO: 97947
  derived and/or modified sequence opt2 from hemagglutinin__InfluenzaA__AJJ99379

SEQ ID NO: 104398 - RNA, 1701 nt, Artificial Sequence
  derived and/or modified sequence opt2 from hemagglutinin__InfluenzaA__AJJ99390
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104399 - RNA, 1701 nt, Artificial Sequence; identical to SEQ ID NO: 96297
  derived and/or modified sequence opt2 from hemagglutinin__InfluenzaA__AJJ99401

SEQ ID NO: 104400 - RNA, 1698 nt, Artificial Sequence
  derived and/or modified sequence opt2 from hemagglutinin__InfluenzaA__AJJ99413
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgccuccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104401 - RNA, 1698 nt, Artificial Sequence; identical to SEQ ID NO: 95138
  derived and/or modified sequence opt2 from hemagglutinin__InfluenzaA__AJJ99425

SEQ ID NO: 104402 - RNA, 1698 nt, Artificial Sequence
  derived and/or modified sequence opt2 from hemagglutinin__InfluenzaA__AJJ99437
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccucccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104403 - RNA, 1698 nt, Artificial Sequence
  derived and/or modified sequence opt2 from hemagglutinin__InfluenzaA__AJJ99449
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104404 - RNA, 1698 nt, Artificial Sequence; identical to SEQ ID NO: 94000
  derived and/or modified sequence opt2 from hemagglutinin__InfluenzaA__AJJ99461

SEQ ID NO: 104405 - RNA, 1701 nt, Artificial Sequence
  derived and/or modified sequence opt2 from hemagglutinin__InfluenzaA__AJJ99483
augaaggccauccuccucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104406 - RNA, 1701 nt, Artificial Sequence; identical to SEQ ID NO: 98565
  derived and/or modified sequence opt2 from hemagglutinin__InfluenzaA__AJJ99494

SEQ ID NO: 104407 - RNA, 1701 nt, Artificial Sequence
  derived and/or modified sequence opt2 from hemagglutinin__InfluenzaA__AJJ99505
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaagggcuucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104408 - RNA, 1701 nt, Artificial Sequence; identical to SEQ ID NO: 94423
  derived and/or modified sequence opt2 from hemagglutinin__InfluenzaA__AJJ99516

SEQ ID NO: 104409 - RNA, 1701 nt, Artificial Sequence
  derived and/or modified sequence opt2 from hemagglutinin__InfluenzaA__AJJ99527
augaaggccauccuccucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgucaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104410 - RNA, 1701 nt, Artificial Sequence
  derived and/or modified sequence opt2 from hemagglutinin__InfluenzaA__AJJ99538
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104411 - RNA, 1701 nt, Artificial Sequence
  derived and/or modified sequence opt2 from hemagglutinin__InfluenzaA__AJJ99549
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 104412 - RNA, 1701 nt, Artificial Sequence; identical to SEQ ID NO: 98601
  derived and/or modified sequence opt2 from hemagglutinin__InfluenzaA__AJJ99560

SEQ ID NO: 104413 - RNA, 1701 nt, Artificial Sequence
  derived and/or modified sequence opt2 from hemagglutinin__InfluenzaA__AJJ99571
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacauccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104414 - RNA, 1701 nt, Artificial Sequence
  derived and/or modified sequence opt2 from hemagglutinin__InfluenzaA__AJJ99582
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaacggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104415 - RNA, 1701 nt, Artificial Sequence; identical to SEQ ID NO: 94423
  derived and/or modified sequence opt2 from hemagglutinin__InfluenzaA__AJJ99593

SEQ ID NO: 104416 - RNA, 1701 nt, Artificial Sequence
  derived and/or modified sequence opt2 from hemagglutinin__InfluenzaA__AJJ99604
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgcccccgcguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104417 - RNA, 1698 nt, Artificial Sequence
  derived and/or modified sequence opt2 from hemagglutinin__InfluenzaA__AJJ99616
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccaaccagaagacccucuaccacaccgagaacgccuacgucuccgucgucuccucccacuacucccgcaagcucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104418 - RNA, 1698 nt, Artificial Sequence; identical to SEQ ID NO: 95138
  derived and/or modified sequence opt2 from hemagglutinin__InfluenzaA__AJJ99628

SEQ ID NO: 104419 - RNA, 1698 nt, Artificial Sequence
  derived and/or modified sequence opt2 from hemagglutinin__InfluenzaA__AJJ99640
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccgucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104420 - RNA, 1698 nt, Artificial Sequence; identical to SEQ ID NO: 95138
  derived and/or modified sequence opt2 from hemagglutinin__InfluenzaA__AJJ99652

SEQ ID NO: 104421 - RNA, 1698 nt, Artificial Sequence
  derived and/or modified sequence opt2 from hemagglutinin__InfluenzaA__AJJ99664
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccaucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104422 - RNA, 1701 nt, Artificial Sequence
  derived and/or modified sequence opt2 from hemagglutinin__InfluenzaA__AJJ99675
augaaggccauccuccucguccuccucuacaccuucgccaccgccaaggccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccgacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104423 - RNA, 1701 nt, Artificial Sequence
  derived and/or modified sequence opt2 from hemagglutinin__InfluenzaA__AJJ99686
augaccgccauccuccucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104424 - RNA, 1701 nt, Artificial Sequence
  derived and/or modified sequence opt2 from hemagglutinin__InfluenzaA__AJJ99697
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgucauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104425 - RNA, 1701 nt, Artificial Sequence
  derived and/or modified sequence opt2 from hemagglutinin__InfluenzaA__AJJ99708
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgucauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104426 - RNA, 1701 nt, Artificial Sequence
  derived and/or modified sequence opt2 from hemagglutinin__InfluenzaA__AJJ99719
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgagggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104427 - RNA, 1701 nt, Artificial Sequence
  derived and/or modified sequence opt2 from hemagglutinin__InfluenzaA__AJJ99730
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguuccaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104428 - RNA, 1701 nt, Artificial Sequence; identical to SEQ ID NO: 98554
  derived and/or modified sequence opt2 from hemagglutinin__InfluenzaA__AJJ99741

SEQ ID NO: 104429 - RNA, 1701 nt, Artificial Sequence; identical to SEQ ID NO: 95345
  derived and/or modified sequence opt2 from hemagglutinin__InfluenzaA__AJJ99752

SEQ ID NO: 104430 - RNA, 1701 nt, Artificial Sequence; identical to SEQ ID NO: 94181
  derived and/or modified sequence opt2 from hemagglutinin__InfluenzaA__AJJ99763

SEQ ID NO: 104431 - RNA, 1698 nt, Artificial Sequence
  derived and/or modified sequence opt2 from hemagglutinin__InfluenzaA__AJJ99775
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaccgacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104432 - RNA, 1701 nt, Artificial Sequence
  derived and/or modified sequence opt2 from hemagglutinin__InfluenzaA__AJJ99786
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccgccgucgccuccucccucguccucgucgucucccucggcgccaucuccuucuggaugugcuccaacggcucccuccagugccgcaucugcaucuga

SEQ ID NO: 104433 - RNA, 1698 nt, Artificial Sequence
  derived and/or modified sequence opt2 from hemagglutinin__InfluenzaA__AJJ99798
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccaacaucgccaaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucauguucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104434 - RNA, 1698 nt, Artificial Sequence; identical to SEQ ID NO: 94000
  derived and/or modified sequence opt2 from hemagglutinin__InfluenzaA__AJJ99810

SEQ ID NO: 104435 - RNA, 1698 nt, Artificial Sequence
  derived and/or modified sequence opt2 from hemagglutinin__InfluenzaA__AJJ99822
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuucauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104436 - RNA, 1701 nt, Artificial Sequence
  derived and/or modified sequence opt2 from hemagglutinin__InfluenzaA__AJJ99833
augaaggccauccuccucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccucaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104437 - RNA, 1701 nt, Artificial Sequence; identical to SEQ ID NO: 98336
  derived and/or modified sequence opt2 from hemagglutinin__InfluenzaA__AJJ99844

SEQ ID NO: 104438 - RNA, 1701 nt, Artificial Sequence
  derived and/or modified sequence opt2 from hemagglutinin__InfluenzaA__AJJ99855
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacuccaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104439 - RNA, 1701 nt, Artificial Sequence
  derived and/or modified sequence opt2 from hemagglutinin__InfluenzaA__AJJ99866
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104440 - RNA, 1701 nt, Artificial Sequence
  derived and/or modified sequence opt2 from hemagglutinin__InfluenzaA__AJJ99877
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacguccgcaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104441 - RNA, 1701 nt, Artificial Sequence
  derived and/or modified sequence opt2 from hemagglutinin__InfluenzaA__AJJ99888
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104442 - RNA, 1701 nt, Artificial Sequence
  derived and/or modified sequence opt2 from hemagglutinin__InfluenzaA__AJJ99899
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaaccucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccuccucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacggccagggcuccggcuacgccgccgaccucaaguccacccagaacgccgucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104443 - RNA, 1701 nt, Artificial Sequence
  derived and/or modified sequence opt2 from hemagglutinin__InfluenzaA__AJJ99910
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104444 - RNA, 1701 nt, Artificial Sequence; identical to SEQ ID NO: 98336
  derived and/or modified sequence opt2 from hemagglutinin__InfluenzaA__AJJ99921

SEQ ID NO: 104445 - RNA, 1701 nt, Artificial Sequence
  derived and/or modified sequence opt2 from hemagglutinin__InfluenzaA__AJJ99932
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104446 - RNA, 1701 nt, Artificial Sequence; identical to SEQ ID NO: 97966
  derived and/or modified sequence opt2 from hemagglutinin__InfluenzaA__AJJ99943

SEQ ID NO: 104447 - RNA, 1701 nt, Artificial Sequence
  derived and/or modified sequence opt2 from hemagglutinin__InfluenzaA__AJJ99954
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaccuccgacacccccguccacgacugcaacaccaccugccagacccccaagggcgccaucaacaccucccuccccuuccagaacauccaccccaucaccaucggcaacugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104448 - RNA, 1701 nt, Artificial Sequence; identical to SEQ ID NO: 94423
  derived and/or modified sequence opt2 from hemagglutinin__InfluenzaA__AJJ99965

SEQ ID NO: 104449 - RNA, 1698 nt, Artificial Sequence
  derived and/or modified sequence opt2 from hemagglutinin__InfluenzaA__AJJ99989
augaaggucaagcuccucguccuccucugcaccuucaccgccaccuacgccgacaccaucugcaucggcuaccacgccaacaacuccaccgacaccgucgacaccguccucgagcgcaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacuccaagaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagcgcuccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104450 - RNA, 1701 nt, Artificial Sequence
  derived and/or modified sequence opt2 from hemagglutinin__InfluenzaA__AJK00001
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgagaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104451 - RNA, 1701 nt, Artificial Sequence
  derived and/or modified sequence opt2 from hemagglutinin__InfluenzaA__AJK00012
augaaggccauccucgucguccuccucugcaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccaccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcgacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104452 - RNA, 1701 nt, Artificial Sequence
  derived and/or modified sequence opt2 from hemagglutinin__InfluenzaA__AJK00023
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104453 - RNA, 1701 nt, Artificial Sequence; identical to SEQ ID NO: 98336
  derived and/or modified sequence opt2 from hemagglutinin__InfluenzaA__AJK00034

SEQ ID NO: 104454 - RNA, 1701 nt, Artificial Sequence; identical to SEQ ID NO: 98554
  derived and/or modified sequence opt2 from hemagglutinin__InfluenzaA__AJK00045

SEQ ID NO: 104455 - RNA, 1701 nt, Artificial Sequence; identical to SEQ ID NO: 98554
  derived and/or modified sequence opt2 from hemagglutinin__InfluenzaA__AJK00056

SEQ ID NO: 104456 - RNA, 1701 nt, Artificial Sequence; identical to SEQ ID NO: 94423
  derived and/or modified sequence opt2 from hemagglutinin__InfluenzaA__AJK00067

SEQ ID NO: 104457 - RNA, 1698 nt, Artificial Sequence
  derived and/or modified sequence opt2 from hemagglutinin__InfluenzaA__AJK00079
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgagaacuccuucuaccgcaaccuccucuggcucacccgcaagaacggccucuaccccaaccucuccaaguccuacgccaacaacaaggagaaggagguccucguccucuggggcguccaccacccccccaacaucgccgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104458 - RNA, 1698 nt, Artificial Sequence
  derived and/or modified sequence opt2 from hemagglutinin__InfluenzaA__AJK00091
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccaucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcguccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccgucuccuucuggaugugcuccaacggcucccuccagugccgcgucugcaucuga

SEQ ID NO: 104459 - RNA, 1698 nt, Artificial Sequence; identical to SEQ ID NO: 94000
  derived and/or modified sequence opt2 from hemagglutinin__InfluenzaA__AJK00103

SEQ ID NO: 104460 - RNA, 1701 nt, Artificial Sequence; identical to SEQ ID NO: 98432
  derived and/or modified sequence opt2 from hemagglutinin__InfluenzaA__AJK00114

SEQ ID NO: 104461 - RNA, 1701 nt, Artificial Sequence
  derived and/or modified sequence opt2 from hemagglutinin__InfluenzaA__AJK00125
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcgaggucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgucuacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104462 - RNA, 1701 nt, Artificial Sequence; identical to SEQ ID NO: 94181
  derived and/or modified sequence opt2 from hemagglutinin__InfluenzaA__AJK00136

SEQ ID NO: 104463 - RNA, 1704 nt, Artificial Sequence
  derived and/or modified sequence opt2 from hemagglutinin__InfluenzaA__AJK00166
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcaagcccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 104464 - RNA, 1707 nt, Artificial Sequence
  derived and/or modified sequence opt2 from hemagglutinin__InfluenzaA__AJK00177
auggagaagaucguccuccuccucgccgucgucucccucguccgcuccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaaccucaacgacuacgaggagcucaagcaccuccucucccgcaucaaccacuucgagaagauccagaucauccccaaguccuccugguccgaccacgaggccucccucggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgaggccgagcagaucaagcucuaccagaaccccaccaccuacgucuccgucggcaccuccacccucaaccagcgccucguccccaagaucgccacccgcuccaaggucaacggccaguccggccgcauggacuucuucuggaccauccucaagcccgacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagaagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 104465 - RNA, 1704 nt, Artificial Sequence
  derived and/or modified sequence opt2 from hemagglutinin__InfluenzaA__AJK00188
auggagaagaucguccuccuccucgccgucgucucccucguccgcuccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaaccucaacgacuacgaggagcucaagcaccuccucucccgcaucaaccacuucgagaagauccagaucauccccaaguccuccugguccgaccacgaggccucccucggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgaggccgagcagaucaagcucuaccagaaccccaccaccuacaucuccgucggcaccuccacccucaaccagcgccucguccccaagaucgccacccgcuccaaggucaacggccaguccggccgcauggacuucuucuggaccauccucaagcccgacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagaagcgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 104466 - RNA, 1704 nt, Artificial Sequence
  derived and/or modified sequence opt2 from hemagglutinin__InfluenzaA__AJK00207
auggagaagaucguccuccuccucgccaucgucucccucguccgcuccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccucccaggaggaccuccucguccucuggggcauccaccacuccaacgacgccaccgagcagaugaagcucuaccagaaccccaccaccuacgucuccgucggcaccuccacccucaaccagcgccucguccccaagaucgccacccgcuccaaggucaacggccaguccggccgcauggacuucuucuggaccauccucaaguccaacgacgccaucaacuucgaguccaacggcaacuucaucgcccccgaguacgccuacaagaucgucaagaagggcgacuccgccaucaugaaguccgaggucgaguacggcaacugcuccaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacaccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 104467 - RNA, 1704 nt, Artificial Sequence
  derived and/or modified sequence opt2 from hemagglutinin__InfluenzaA__AJK00218
auggagaagaucguccucuuccucgccaucgucucccucguccgcuccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccgcaucauccccaaguccuccuggcccgaccacgaggccuccuccggcgucuccuccgccugccccuaccagggcacccccuccuucuuccgcaacaucgucuggcucaucaagaagaacaacaccuaccccaccaucaagcgcuccuacaacaacaccucccaggaggaccuccucguccucuggggcauccaccacuccuccgacgccaccgagcagaucaagcucuaccagaaccccaccaccuacgucuccgucggcaccuccacccucaaccagcgccucguccccaagaucgccacccgcuccaaggucaacggccaguccggccgcauggacuucuucuggaccauccucaaguccaacgacgccaucaacuucgaguccaacggcaacuucaucgcccccgaguacgccuacaagaucgucaagaagggcgacuccgccaucaugaaguccgaggucgaguacggcaacugcuccaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgccgccuccucccucgcccucgccaucauggucgccggccucucccucuggaugugcuccaacggcucccuccagugccgcaucugcaucuga

SEQ ID NO: 104468 - RNA, 1704 nt, Artificial Sequence
  derived and/or modified sequence opt2 from hemagglutinin__InfluenzaA__AJK00239
auggagaagaucguccuccuccucgccaucgucucccucguccgcuccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccucccaggaggaccuccucguccucuggggcauccaccacuccaacgacgccaccgagcagaugaagcucuaccagaaccccaccaccuacgucuccgucggcaccuccacccucaaccagcgccucguccccaagaucgccacccgcuccaaggucaacggccaguccggccgcauggacuucuucuggaccauccucaaguccaacgacgccaucaacuucgaguccaacggcaacuucaucgcccccgaguacgccuacaagaucgucaagaagggcgacuccgccaucaugaaguccgaggucgaguacggcaacugcuccaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 104469 - RNA, 1704 nt, Artificial Sequence
  derived and/or modified sequence opt2 from hemagglutinin__InfluenzaA__AJS18468
auggagaagaucguccuccuccucgccgucgucucccucgucaaguccgaccagaucugcaucggcuaccacgccaacaacuccaccgagcaggucgacaccaucauggagaagaacgucaccgucacccacgcccaggacauccucgagaagacccacaacggccgccucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagacccucaucauccccaaguccuccuggcccaaccacgagaccucccucggcgucuccgccgccugccccuaccagggcguccccuccuucuuccgcaacgucgucuggcucaccaagaagaacgacgccuaccccaccaucaagauguccuacaacaacaccaaccgcgaggaccuccucauccucuggggcauccaccacuccaacaacgccgccgagcagaccaaccucuacaagaaccccaccaccuacgucuccgucggcaccuccacccucaaccagcgccucguccccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgaccgcgaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucacccucgccaucaucgucgccggccucucccucuggaugugcuccaacggcucccuccagugccgcaucugcaucuga

SEQ ID NO: 104470 - RNA, 1704 nt, Artificial Sequence
  derived and/or modified sequence opt2 from hemagglutinin__InfluenzaA__AJS18479
auggagaagaucguccuccuccucgccgucgucucccucgucaaguccgaccagaucugcaucggcuaccacgccaacaacuccaccgagcaggucgacaccaucauggagaagaacgucaccgucacccacgcccaggacauccucgagaagacccacaacggccgccucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagacccucaucauccccaaguccuccuggcccaaccacgagaccucccucggcgucuccgccgccugccccuaccagggcaugcccuccuucuuccgcaacgucgucuggcucaccaagaagaacgacaccuaccccaccaucaagauguccuacaacaacaccaaccgcgaggaccuccucauccucuggggcauccaccacuccaacaacgccgccgagcagaccaaccucuacaagaaccccaccaccuacgucuccgucggcaccgccacccucaaccagcgccucguccccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgaccgcgaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 104471 - RNA, 1704 nt, Artificial Sequence
  derived and/or modified sequence opt2 from hemagglutinin__InfluenzaA__AJY79339
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaaccucaacgacuacgaggagcucaagcaccuccucucccgcaucaaccacuucgagaagauccagaucauccccaaggacuccugguccgaccacgaggccuccggcgucuccuccgccugccccuaccagggccgcuccuccuucuuccgcaacgucgucuggcucaccaagaagaacgacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacuccaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagaagcgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 104472 - RNA, 1704 nt, Artificial Sequence
  derived and/or modified sequence opt2 from hemagglutinin__InfluenzaA__AJY79341
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaggacuccugguccgaccacgagaccuccggcgucuccuccgccugccccuaccagggccgcuccuccuucuuccgcaacgucgucuggcucaccaagaagaacgacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccagaacggccgcauggaguucuucuggaccauccucaaguccaacgacgccaucaacuucgaguccaacggcaacuucaucgcccccgagaacgccuacaagaucgucaagaagggcgacuccaccaucaugcgcuccgagcucgaguacuccaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagaagcgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 104473 - RNA, 1704 nt, Artificial Sequence
  derived and/or modified sequence opt2 from hemagglutinin__InfluenzaA__AJY79342
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaggacuccugguccgaccacgaggccuccggcgucuccuccgccugccccuaccagggccgcuccuccuucuuccgcaacgucgucuggcucaccaagaagaacgacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacuccaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagaagcgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 104474 - RNA, 1704 nt, Artificial Sequence
  derived and/or modified sequence opt2 from hemagglutinin__InfluenzaA__AJY79343
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaggacuccugguccgaccacgaggccuccggcgucuccuccgccugccccuaccagggccgcuccuccuucuuccgcaacgucgucuggcucaccaagaagaacgacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacuccaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagaagcgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacgacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 104475 - RNA, 1704 nt, Artificial Sequence
  derived and/or modified sequence opt2 from hemagglutinin__InfluenzaA__AJY79345
auggagaagaucguccuccuccucgccaucgucuccaucgucaaguccgaccagaucugcaucggcuaccacgccaacaacuccaccgagcaggucgacaccaucauggagaagaacgucaccgucacccgcgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaggacuccugguccgaccacgaggccuccggcgucuccuccgccugccccuaccagggccgcuccuccuucuuccgcaacgucgucuggcucaccaagaagaacgacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacuccaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagaagcgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 104476 - RNA, 1701 nt, Artificial Sequence; identical to SEQ ID NO: 103953
  derived and/or modified sequence opt2 from hemagglutinin__InfluenzaA__AKA54643

SEQ ID NO: 104477 - RNA, 1701 nt, Artificial Sequence
  derived and/or modified sequence opt2 from hemagglutinin__InfluenzaA__AKA54650
augaagaccaucaucgcccucuccuacauccucugccucgucuucacccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104478 - RNA, 1701 nt, Artificial Sequence
  derived and/or modified sequence opt2 from hemagglutinin__InfluenzaA__AKA54651
augaagaccaucaucgccuucuccugcauccucugccagaucuccgcccagaagcuccccggcuccgacaacuccauggccacccucugccucggccaccacgccguccccaacggcacccucgucaagaccaucaccgacgaccagaucgaggucaccaacgccaccgagcucguccaguccaccuccaagggcgagaucugcuccuccccccaccagauccucgacggcaagaacugcacccucaucgacgcccuccucggcgacccccacugcgacgacuuccagaacaagaagugggaccucuucgucgagcgcuccaccgccuacuccaacugcuaccccuacuacguccccgacuacgccucccuccgcucccucgucgccuccuccggcacccucgaguucacccaggaguccuucaacuggaccggcgucgcccaggacggcgccuccuacuccugccgccgcgaguccgagaacuccuucuucucccgccucaacuggcucuacucccucaacuacaaguaccccgcccucaacgucaccaugcccaacaacgacaaguucgacaagcucuacaucuggggcguccaccaccccggcaccgacaaggaccagaccucccucuacauccaggccuccggccgcgucaccgucuccaccaaguggucccagcagaccgucauccccaacaucggcucccgccccuggauccgcggcgucuccuccaucaucuccaucuacuggaccaucgucaagcccggcgacauccuccucaucaacuccaccggcaaccucaucgccccccgcggcuacuucaagauccaguccggcaaguccuccaucaugcgcuccgacgcccacaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaccggcaagcucaaccgcgucaucaagaagaccaacgagaaguuccaccagaucgagaaggaguucuccgaggucgagggccgcauccaggaccucgagcgcuacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggccgucaacaaccgcuuccagaucaagggcguccagcucaagcucggcuacaaggacuggauccucuggaucuccuucgccaucuccugcuuccuccucugcgccguccuccucggcuucaucaugugggccugccagaagggcaacauccgcugcaacaucugcaucuga

SEQ ID NO: 104479 - RNA, 1701 nt, Artificial Sequence
  derived and/or modified sequence opt2 from hemagglutinin__InfluenzaA__AKA59351
augaaggccauccucgucauccuccucuacaccuucgccgccgccaacgccgacaccaucugcaucggcuaccacgccaacaacuccaccgacaccgucgacaccguccucgagaagaacgucaccgucacccacuccgucgaccuccucgaggacaagcacaacggccgccucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccaggccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104480 - RNA, 1701 nt, Artificial Sequence
  derived and/or modified sequence opt2 from hemagglutinin__InfluenzaA__AKA59353
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcgagugcaacaucgccggcuggauccucggcaaccccgagugcgagucccucuccaccgccuccuccugguccuacaucgucgagacccccuccuccaacaacggcaccugcuaccccggcgacuucaucgacuacgaggagcuccgcgagcagcucuccuccgucuccuccuucgagcgcuucgagaucuuccccaacaccuccuccuggcccaaccacgacuccuccaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagaagcucuaccagaacgaggacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaacaucgucgucccccgcuacgccuucgccauggagcgcaacgccggcuccggcaucaucaucuccgacacccccguccacaacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuucgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaaccgcaagaucgacgacggcuuccucgacaucuggaccuacaacgccgagcuccucauccuccucgagaacgagcgcacccucgacuaccacgacuccaacguccgcaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 104481 - RNA, 1701 nt, Artificial Sequence
  derived and/or modified sequence opt2 from hemagglutinin__InfluenzaA__AKA59355
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgcccgcuccuucuacaagaaccucaucuggcucgucaagaagggcaacuccuaccccaagcucaaccaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaaccucgucaucgagaagaugaacacccaguucaccgccgucggcaaggaguucucccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagauccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 104482 - RNA, 1701 nt, Artificial Sequence
  derived and/or modified sequence opt2 from hemagglutinin__InfluenzaA__AKE37137
augaaggcccgccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaccuccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccuucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104483 - RNA, 1701 nt, Artificial Sequence
  derived and/or modified sequence opt2 from hemagglutinin__InfluenzaA__AKS48035
auggagaagaugguccuccuccucgccgucgucucccucgucaaguccgaccagaucugcaucggcuaccacgccaacaacuccaccgagcaggucgacaccaucauggagaagaacgucaccgucacccacgcccaggacauccucgagaagacccacaacggccgccucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagacccucaucauccccaaguccuccuggcccaaccacaccuccuccggcgucuccgccgccugccccuaccagggcaugcccuccuucuuccgcaacgucgucuggcucaccaagaagaacgacgccuaccccaccaucaagauguccuacaacaacaccuaccgcgaggaccuccucauccucuggggcauccaccacuccaacaacgccgccgagcagaccaaccucuacaagaaccccaccaccuacgucuccgucggcaccuccacccucaaccagcgccucgagcccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgaccgcgaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 104484 - RNA, 1701 nt, Artificial Sequence
  derived and/or modified sequence opt2 from hemagglutinin__InfluenzaA__ALA08472
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacgucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104485 - RNA, 1701 nt, Artificial Sequence; identical to SEQ ID NO: 103953
  derived and/or modified sequence opt2 from hemagglutinin__InfluenzaA__ALA08475

SEQ ID NO: 104486 - RNA, 1701 nt, Artificial Sequence
  derived and/or modified sequence opt2 from hemagglutinin__InfluenzaA__ALA08478
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104487 - RNA, 1701 nt, Artificial Sequence; identical to SEQ ID NO: 101506
  derived and/or modified sequence opt2 from hemagglutinin__InfluenzaA__ALA08479

SEQ ID NO: 104488 - RNA, 1701 nt, Artificial Sequence
  derived and/or modified sequence opt2 from hemagglutinin__InfluenzaA__ALA08481
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104489 - RNA, 1701 nt, Artificial Sequence; identical to SEQ ID NO: 104488
  derived and/or modified sequence opt2 from hemagglutinin__InfluenzaA__ALA08482

SEQ ID NO: 104490 - RNA, 1701 nt, Artificial Sequence
  derived and/or modified sequence opt2 from hemagglutinin__InfluenzaA__ALA08483
augaagaccaucaucggccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104491 - RNA, 1701 nt, Artificial Sequence
  derived and/or modified sequence opt2 from hemagglutinin__InfluenzaA__ALA08484
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccaucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104492 - RNA, 1701 nt, Artificial Sequence
  derived and/or modified sequence opt2 from hemagglutinin__InfluenzaA__ALA08488
augaagaccaucaucgcccucuccuacauccucugccucgucuucgcccagaagauccccggcaacggcaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104493 - RNA, 1701 nt, Artificial Sequence
  derived and/or modified sequence opt2 from hemagglutinin__InfluenzaA__ALA08490
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104494 - RNA, 1701 nt, Artificial Sequence
  derived and/or modified sequence opt2 from hemagglutinin__InfluenzaA__ALA08491
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacaugaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104495 - RNA, 1701 nt, Artificial Sequence; identical to SEQ ID NO: 104493
  derived and/or modified sequence opt2 from hemagglutinin__InfluenzaA__ALA08492

SEQ ID NO: 104496 - RNA, 1701 nt, Artificial Sequence
  derived and/or modified sequence opt2 from hemagglutinin__InfluenzaA__ALA08493
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugccgcuccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104497 - RNA, 1701 nt, Artificial Sequence
  derived and/or modified sequence opt2 from hemagglutinin__InfluenzaA__ALA08494
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104498 - RNA, 1701 nt, Artificial Sequence; identical to SEQ ID NO: 104497
  derived and/or modified sequence opt2 from hemagglutinin__InfluenzaA__ALA08495

SEQ ID NO: 104499 - RNA, 1701 nt, Artificial Sequence; identical to SEQ ID NO: 104497
  derived and/or modified sequence opt2 from hemagglutinin__InfluenzaA__ALA08496

SEQ ID NO: 104500 - RNA, 1701 nt, Artificial Sequence; identical to SEQ ID NO: 103953
  derived and/or modified sequence opt2 from hemagglutinin__InfluenzaA__ALA08497

SEQ ID NO: 104501 - RNA, 1701 nt, Artificial Sequence; identical to SEQ ID NO: 103953
  derived and/or modified sequence opt2 from hemagglutinin__InfluenzaA__ALA08498

SEQ ID NO: 104502 - RNA, 1701 nt, Artificial Sequence
  derived and/or modified sequence opt2 from hemagglutinin__InfluenzaA__ALA08499
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104503 - RNA, 1701 nt, Artificial Sequence; identical to SEQ ID NO: 104486
  derived and/or modified sequence opt2 from hemagglutinin__InfluenzaA__ALA08501

SEQ ID NO: 104504 - RNA, 1701 nt, Artificial Sequence
  derived and/or modified sequence opt2 from hemagglutinin__InfluenzaA__ALA08502
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaaggucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104505 - RNA, 1701 nt, Artificial Sequence; identical to SEQ ID NO: 104504
  derived and/or modified sequence opt2 from hemagglutinin__InfluenzaA__ALA08503

SEQ ID NO: 104506 - RNA, 1701 nt, Artificial Sequence; identical to SEQ ID NO: 103953
  derived and/or modified sequence opt2 from hemagglutinin__InfluenzaA__ALA08504

SEQ ID NO: 104507 - RNA, 1701 nt, Artificial Sequence; identical to SEQ ID NO: 103953
  derived and/or modified sequence opt2 from hemagglutinin__InfluenzaA__ALA08505

SEQ ID NO: 104508 - RNA, 1701 nt, Artificial Sequence; identical to SEQ ID NO: 103953
  derived and/or modified sequence opt2 from hemagglutinin__InfluenzaA__ALA08506

SEQ ID NO: 104509 - RNA, 1701 nt, Artificial Sequence; identical to SEQ ID NO: 103953
  derived and/or modified sequence opt2 from hemagglutinin__InfluenzaA__ALA08507

SEQ ID NO: 104510 - RNA, 1701 nt, Artificial Sequence
  derived and/or modified sequence opt2 from hemagglutinin__InfluenzaA__ALA08508
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104511 - RNA, 1701 nt, Artificial Sequence; identical to SEQ ID NO: 103953
  derived and/or modified sequence opt2 from hemagglutinin__InfluenzaA__ALA08509

SEQ ID NO: 104512 - RNA, 1701 nt, Artificial Sequence; identical to SEQ ID NO: 103953
  derived and/or modified sequence opt2 from hemagglutinin__InfluenzaA__ALA08510

SEQ ID NO: 104513 - RNA, 1701 nt, Artificial Sequence
  derived and/or modified sequence opt2 from hemagglutinin__InfluenzaA__ALA08511
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccuccaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104514 - RNA, 1701 nt, Artificial Sequence; identical to SEQ ID NO: 103953
  derived and/or modified sequence opt2 from hemagglutinin__InfluenzaA__ALA08512

SEQ ID NO: 104515 - RNA, 1701 nt, Artificial Sequence; identical to SEQ ID NO: 103953
  derived and/or modified sequence opt2 from hemagglutinin__InfluenzaA__ALA08514

SEQ ID NO: 104516 - RNA, 1701 nt, Artificial Sequence; identical to SEQ ID NO: 103953
  derived and/or modified sequence opt2 from hemagglutinin__InfluenzaA__ALA08515

SEQ ID NO: 104517 - RNA, 1701 nt, Artificial Sequence; identical to SEQ ID NO: 103953
  derived and/or modified sequence opt2 from hemagglutinin__InfluenzaA__ALA08516

SEQ ID NO: 104518 - RNA, 1701 nt, Artificial Sequence; identical to SEQ ID NO: 104510
  derived and/or modified sequence opt2 from hemagglutinin__InfluenzaA__ALA08517

SEQ ID NO: 104519 - RNA, 1701 nt, Artificial Sequence; identical to SEQ ID NO: 103953
  derived and/or modified sequence opt2 from hemagglutinin__InfluenzaA__ALA08519

SEQ ID NO: 104520 - RNA, 1701 nt, Artificial Sequence
  derived and/or modified sequence opt2 from hemagglutinin__InfluenzaA__ALA08520
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104521 - RNA, 1701 nt, Artificial Sequence; identical to SEQ ID NO: 101650
  derived and/or modified sequence opt2 from hemagglutinin__InfluenzaA__ALA08522

SEQ ID NO: 104522 - RNA, 1701 nt, Artificial Sequence
  derived and/or modified sequence opt2 from hemagglutinin__InfluenzaA__ALA08523
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaucggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104523 - RNA, 1701 nt, Artificial Sequence
  derived and/or modified sequence opt2 from hemagglutinin__InfluenzaA__ALA08524
augaagaccaucaucgcccucuccuacauccucugcauggucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgccuccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104524 - RNA, 1701 nt, Artificial Sequence; identical to SEQ ID NO: 103953
  derived and/or modified sequence opt2 from hemagglutinin__InfluenzaA__ALA08525

SEQ ID NO: 104525 - RNA, 1701 nt, Artificial Sequence; identical to SEQ ID NO: 103953
  derived and/or modified sequence opt2 from hemagglutinin__InfluenzaA__ALA08526

SEQ ID NO: 104526 - RNA, 1701 nt, Artificial Sequence; identical to SEQ ID NO: 104510
  derived and/or modified sequence opt2 from hemagglutinin__InfluenzaA__ALA08527

SEQ ID NO: 104527 - RNA, 1701 nt, Artificial Sequence
  derived and/or modified sequence opt2 from hemagglutinin__InfluenzaA__ALA08528
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuaccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104528 - RNA, 1701 nt, Artificial Sequence; identical to SEQ ID NO: 103953
  derived and/or modified sequence opt2 from hemagglutinin__InfluenzaA__ALA08529

SEQ ID NO: 104529 - RNA, 1701 nt, Artificial Sequence; identical to SEQ ID NO: 103953
  derived and/or modified sequence opt2 from hemagglutinin__InfluenzaA__ALA08530

SEQ ID NO: 104530 - RNA, 1701 nt, Artificial Sequence
  derived and/or modified sequence opt2 from hemagglutinin__InfluenzaA__ALA08531
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104531 - RNA, 1701 nt, Artificial Sequence; identical to SEQ ID NO: 103953
  derived and/or modified sequence opt2 from hemagglutinin__InfluenzaA__ALA08532

SEQ ID NO: 104532 - RNA, 1701 nt, Artificial Sequence; identical to SEQ ID NO: 103953
  derived and/or modified sequence opt2 from hemagglutinin__InfluenzaA__ALA08533

SEQ ID NO: 104533 - RNA, 1701 nt, Artificial Sequence; identical to SEQ ID NO: 103953
  derived and/or modified sequence opt2 from hemagglutinin__InfluenzaA__ALA08534

SEQ ID NO: 104534 - RNA, 1701 nt, Artificial Sequence; identical to SEQ ID NO: 103953
  derived and/or modified sequence opt2 from hemagglutinin__InfluenzaA__ALA08535

SEQ ID NO: 104535 - RNA, 1701 nt, Artificial Sequence; identical to SEQ ID NO: 104510
  derived and/or modified sequence opt2 from hemagglutinin__InfluenzaA__ALA08536

SEQ ID NO: 104536 - RNA, 1701 nt, Artificial Sequence; identical to SEQ ID NO: 104510
  derived and/or modified sequence opt2 from hemagglutinin__InfluenzaA__ALA08537

SEQ ID NO: 104537 - RNA, 1701 nt, Artificial Sequence; identical to SEQ ID NO: 104510
  derived and/or modified sequence opt2 from hemagglutinin__InfluenzaA__ALA08538

SEQ ID NO: 104538 - RNA, 1701 nt, Artificial Sequence; identical to SEQ ID NO: 103953
  derived and/or modified sequence opt2 from hemagglutinin__InfluenzaA__ALA08539

SEQ ID NO: 104539 - RNA, 1701 nt, Artificial Sequence; identical to SEQ ID NO: 104510
  derived and/or modified sequence opt2 from hemagglutinin__InfluenzaA__ALA08540

SEQ ID NO: 104540 - RNA, 1701 nt, Artificial Sequence; identical to SEQ ID NO: 104510
  derived and/or modified sequence opt2 from hemagglutinin__InfluenzaA__ALA08541

SEQ ID NO: 104541 - RNA, 1701 nt, Artificial Sequence; identical to SEQ ID NO: 104510
  derived and/or modified sequence opt2 from hemagglutinin__InfluenzaA__ALA08542

SEQ ID NO: 104542 - RNA, 1701 nt, Artificial Sequence
  derived and/or modified sequence opt2 from hemagglutinin__InfluenzaA__ALA08543
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgccauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104543 - RNA, 1701 nt, Artificial Sequence; identical to SEQ ID NO: 103953
  derived and/or modified sequence opt2 from hemagglutinin__InfluenzaA__ALA08545

SEQ ID NO: 104544 - RNA, 1701 nt, Artificial Sequence; identical to SEQ ID NO: 103953
  derived and/or modified sequence opt2 from hemagglutinin__InfluenzaA__ALA08546

SEQ ID NO: 104545 - RNA, 1701 nt, Artificial Sequence
  derived and/or modified sequence opt2 from hemagglutinin__InfluenzaA__ALA08548
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucgcccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104546 - RNA, 1701 nt, Artificial Sequence
  derived and/or modified sequence opt2 from hemagglutinin__InfluenzaA__ALA08549
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaccggcgucaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104547 - RNA, 1701 nt, Artificial Sequence; identical to SEQ ID NO: 104510
  derived and/or modified sequence opt2 from hemagglutinin__InfluenzaA__ALA08550

SEQ ID NO: 104548 - RNA, 1701 nt, Artificial Sequence
  derived and/or modified sequence opt2 from hemagglutinin__InfluenzaA__ALA08551
augaagaccaucaucgcccucuccuacauccucugccucgucuucgcccagaagcuccucgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104549 - RNA, 1701 nt, Artificial Sequence; identical to SEQ ID NO: 104510
  derived and/or modified sequence opt2 from hemagglutinin__InfluenzaA__ALA08552

SEQ ID NO: 104550 - RNA, 1701 nt, Artificial Sequence; identical to SEQ ID NO: 104510
  derived and/or modified sequence opt2 from hemagglutinin__InfluenzaA__ALA08553

SEQ ID NO: 104551 - RNA, 1701 nt, Artificial Sequence
  derived and/or modified sequence opt2 from hemagglutinin__InfluenzaA__ALA08554
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucauguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104552 - RNA, 1701 nt, Artificial Sequence
  derived and/or modified sequence opt2 from hemagglutinin__InfluenzaA__ALA08555
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccagaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccuccaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104553 - RNA, 1701 nt, Artificial Sequence
  derived and/or modified sequence opt2 from hemagglutinin__InfluenzaA__ALA08556
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcaucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104554 - RNA, 1701 nt, Artificial Sequence; identical to SEQ ID NO: 104510
  derived and/or modified sequence opt2 from hemagglutinin__InfluenzaA__ALA08557

SEQ ID NO: 104555 - RNA, 1701 nt, Artificial Sequence; identical to SEQ ID NO: 104510
  derived and/or modified sequence opt2 from hemagglutinin__InfluenzaA__ALA08558

SEQ ID NO: 104556 - RNA, 1701 nt, Artificial Sequence
  derived and/or modified sequence opt2 from hemagglutinin__InfluenzaA__ALA08559
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccgccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104557 - RNA, 1701 nt, Artificial Sequence; identical to SEQ ID NO: 103953
  derived and/or modified sequence opt2 from hemagglutinin__InfluenzaA__ALA08560

SEQ ID NO: 104558 - RNA, 1701 nt, Artificial Sequence
  derived and/or modified sequence opt2 from hemagglutinin__InfluenzaA__ALA08561
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaaggagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104559 - RNA, 1701 nt, Artificial Sequence
  derived and/or modified sequence opt2 from hemagglutinin__InfluenzaA__ALA08563
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104560 - RNA, 1701 nt, Artificial Sequence
  derived and/or modified sequence opt2 from hemagglutinin__InfluenzaA__ALA08571
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 104561 - RNA, 1701 nt, Artificial Sequence; identical to SEQ ID NO: 104496
  derived and/or modified sequence opt2 from hemagglutinin__InfluenzaA__ALA08572

SEQ ID NO: 104562 - RNA, 1701 nt, Artificial Sequence; identical to SEQ ID NO: 104493
  derived and/or modified sequence opt2 from hemagglutinin__InfluenzaA__ALA08573

SEQ ID NO: 104563 - RNA, 1701 nt, Artificial Sequence
  derived and/or modified sequence opt2 from hemagglutinin__InfluenzaA__ALA08574
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucuccggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104564 - RNA, 1701 nt, Artificial Sequence
  derived and/or modified sequence opt2 from hemagglutinin__InfluenzaA__ALA08575
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104565 - RNA, 1701 nt, Artificial Sequence; identical to SEQ ID NO: 103953
  derived and/or modified sequence opt2 from hemagglutinin__InfluenzaA__ALA08576

SEQ ID NO: 104566 - RNA, 1701 nt, Artificial Sequence; identical to SEQ ID NO: 103953
  derived and/or modified sequence opt2 from hemagglutinin__InfluenzaA__ALA08577

SEQ ID NO: 104567 - RNA, 1701 nt, Artificial Sequence
  derived and/or modified sequence opt2 from hemagglutinin__InfluenzaA__ALA08579
augaagaccaucaucgcccucuccuacauccucugccucaucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104568 - RNA, 1701 nt, Artificial Sequence
  derived and/or modified sequence opt2 from hemagglutinin__InfluenzaA__ALA08580
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104569 - RNA, 1701 nt, Artificial Sequence
  derived and/or modified sequence opt2 from hemagglutinin__InfluenzaA__ALA08582
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104570 - RNA, 1701 nt, Artificial Sequence; identical to SEQ ID NO: 104569
  derived and/or modified sequence opt2 from hemagglutinin__InfluenzaA__ALA08583

SEQ ID NO: 104571 - RNA, 1701 nt, Artificial Sequence; identical to SEQ ID NO: 104569
  derived and/or modified sequence opt2 from hemagglutinin__InfluenzaA__ALA08584

SEQ ID NO: 104572 - RNA, 1701 nt, Artificial Sequence; identical to SEQ ID NO: 104569
  derived and/or modified sequence opt2 from hemagglutinin__InfluenzaA__ALA08585

SEQ ID NO: 104573 - RNA, 1701 nt, Artificial Sequence; identical to SEQ ID NO: 103953
  derived and/or modified sequence opt2 from hemagglutinin__InfluenzaA__ALA08586

SEQ ID NO: 104574 - RNA, 1701 nt, Artificial Sequence; identical to SEQ ID NO: 104569
  derived and/or modified sequence opt2 from hemagglutinin__InfluenzaA__ALA08587

SEQ ID NO: 104575 - RNA, 1701 nt, Artificial Sequence; identical to SEQ ID NO: 103953
  derived and/or modified sequence opt2 from hemagglutinin__InfluenzaA__ALA08588

SEQ ID NO: 104576 - RNA, 1701 nt, Artificial Sequence; identical to SEQ ID NO: 103953
  derived and/or modified sequence opt2 from hemagglutinin__InfluenzaA__ALA08589

SEQ ID NO: 104577 - RNA, 1701 nt, Artificial Sequence; identical to SEQ ID NO: 104569
  derived and/or modified sequence opt2 from hemagglutinin__InfluenzaA__ALA08590

SEQ ID NO: 104578 - RNA, 1701 nt, Artificial Sequence; identical to SEQ ID NO: 103953
  derived and/or modified sequence opt2 from hemagglutinin__InfluenzaA__ALA08591

SEQ ID NO: 104579 - RNA, 1701 nt, Artificial Sequence; identical to SEQ ID NO: 104510
  derived and/or modified sequence opt2 from hemagglutinin__InfluenzaA__ALA08592

SEQ ID NO: 104580 - RNA, 1701 nt, Artificial Sequence
  derived and/or modified sequence opt2 from hemagglutinin__InfluenzaA__ALA08594
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 104581 - RNA, 1701 nt, Artificial Sequence; identical to SEQ ID NO: 103953
  derived and/or modified sequence opt2 from hemagglutinin__InfluenzaA__ALA08595

SEQ ID NO: 104582 - RNA, 1701 nt, Artificial Sequence; identical to SEQ ID NO: 103953
  derived and/or modified sequence opt2 from hemagglutinin__InfluenzaA__ALA08596

SEQ ID NO: 104583 - RNA, 1701 nt, Artificial Sequence
  derived and/or modified sequence opt2 from hemagglutinin__InfluenzaA__ALA08597
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaacggcaacauccgcugcaacaucugcaucuga

SEQ ID NO: 104584 - RNA, 1701 nt, Artificial Sequence
  derived and/or modified sequence opt2 from hemagglutinin__InfluenzaA__ALA08598
augaagaccaucaucgccuccuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104585 - RNA, 1701 nt, Artificial Sequence; identical to SEQ ID NO: 103953
  derived and/or modified sequence opt2 from hemagglutinin__InfluenzaA__ALA08599

SEQ ID NO: 104586 - RNA, 1701 nt, Artificial Sequence
  derived and/or modified sequence opt2 from hemagglutinin__InfluenzaA__ALA08600
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuaccgcuaccccgcccucaacgucaccaugcccaacaacgagcaguucgacaagcucuacaucuggggcguccaccaccccggcaccgacaaggaccagaucucccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104587 - RNA, 1701 nt, Artificial Sequence; identical to SEQ ID NO: 103953
  derived and/or modified sequence opt2 from hemagglutinin__InfluenzaA__ALA08601

SEQ ID NO: 104588 - RNA, 1701 nt, Artificial Sequence
  derived and/or modified sequence opt2 from hemagglutinin__InfluenzaA__ALA08602
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucucccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104589 - RNA, 1701 nt, Artificial Sequence
  derived and/or modified sequence opt2 from hemagglutinin__InfluenzaA__ALA08603
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaucuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104590 - RNA, 1701 nt, Artificial Sequence; identical to SEQ ID NO: 103953
  derived and/or modified sequence opt2 from hemagglutinin__InfluenzaA__ALA08605

SEQ ID NO: 104591 - RNA, 1701 nt, Artificial Sequence; identical to SEQ ID NO: 103953
  derived and/or modified sequence opt2 from hemagglutinin__InfluenzaA__ALA08606

SEQ ID NO: 104592 - RNA, 1701 nt, Artificial Sequence; identical to SEQ ID NO: 104568
  derived and/or modified sequence opt2 from hemagglutinin__InfluenzaA__ALA08607

SEQ ID NO: 104593 - RNA, 1701 nt, Artificial Sequence
  derived and/or modified sequence opt2 from hemagglutinin__InfluenzaA__ALA08609
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgacaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104594 - RNA, 1701 nt, Artificial Sequence; identical to SEQ ID NO: 104510
  derived and/or modified sequence opt2 from hemagglutinin__InfluenzaA__ALA08610

SEQ ID NO: 104595 - RNA, 1701 nt, Artificial Sequence
  derived and/or modified sequence opt2 from hemagglutinin__InfluenzaA__ALA08611
augaagaucaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccgcauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104596 - RNA, 1701 nt, Artificial Sequence; identical to SEQ ID NO: 104568
  derived and/or modified sequence opt2 from hemagglutinin__InfluenzaA__ALA08612

SEQ ID NO: 104597 - RNA, 1701 nt, Artificial Sequence; identical to SEQ ID NO: 103953
  derived and/or modified sequence opt2 from hemagglutinin__InfluenzaA__ALA08614

SEQ ID NO: 104598 - RNA, 1701 nt, Artificial Sequence; identical to SEQ ID NO: 103953
  derived and/or modified sequence opt2 from hemagglutinin__InfluenzaA__ALA08615

SEQ ID NO: 104599 - RNA, 1701 nt, Artificial Sequence; identical to SEQ ID NO: 103953
  derived and/or modified sequence opt2 from hemagglutinin__InfluenzaA__ALA08616

SEQ ID NO: 104600 - RNA, 1701 nt, Artificial Sequence; identical to SEQ ID NO: 104493
  derived and/or modified sequence opt2 from hemagglutinin__InfluenzaA__ALA08617

SEQ ID NO: 104601 - RNA, 1701 nt, Artificial Sequence
  derived and/or modified sequence opt2 from hemagglutinin__InfluenzaA__ALA08619
augaagaccgucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgagaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaucuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104602 - RNA, 1701 nt, Artificial Sequence; identical to SEQ ID NO: 104568
  derived and/or modified sequence opt2 from hemagglutinin__InfluenzaA__ALA08620

SEQ ID NO: 104603 - RNA, 1701 nt, Artificial Sequence; identical to SEQ ID NO: 104559
  derived and/or modified sequence opt2 from hemagglutinin__InfluenzaA__ALA08621

SEQ ID NO: 104604 - RNA, 1701 nt, Artificial Sequence
  derived and/or modified sequence opt2 from hemagglutinin__InfluenzaA__ALA08622
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104605 - RNA, 1701 nt, Artificial Sequence; identical to SEQ ID NO: 103953
  derived and/or modified sequence opt2 from hemagglutinin__InfluenzaA__ALA08623

SEQ ID NO: 104606 - RNA, 1701 nt, Artificial Sequence; identical to SEQ ID NO: 104559
  derived and/or modified sequence opt2 from hemagglutinin__InfluenzaA__ALA08624

SEQ ID NO: 104607 - RNA, 1701 nt, Artificial Sequence; identical to SEQ ID NO: 103953
  derived and/or modified sequence opt2 from hemagglutinin__InfluenzaA__ALA08625

SEQ ID NO: 104608 - RNA, 1701 nt, Artificial Sequence; identical to SEQ ID NO: 103953
  derived and/or modified sequence opt2 from hemagglutinin__InfluenzaA__ALA08626

SEQ ID NO: 104609 - RNA, 1701 nt, Artificial Sequence; identical to SEQ ID NO: 103953
  derived and/or modified sequence opt2 from hemagglutinin__InfluenzaA__ALA08627

SEQ ID NO: 104610 - RNA, 1701 nt, Artificial Sequence; identical to SEQ ID NO: 104497
  derived and/or modified sequence opt2 from hemagglutinin__InfluenzaA__ALA08629

SEQ ID NO: 104611 - RNA, 1701 nt, Artificial Sequence
  derived and/or modified sequence opt2 from hemagglutinin__InfluenzaA__ALA08630
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104612 - RNA, 1701 nt, Artificial Sequence
  derived and/or modified sequence opt2 from hemagglutinin__InfluenzaA__ALA08631
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaaggagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104613 - RNA, 1701 nt, Artificial Sequence
  derived and/or modified sequence opt2 from hemagglutinin__InfluenzaA__ALA08632
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacgucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104614 - RNA, 1701 nt, Artificial Sequence; identical to SEQ ID NO: 104510
  derived and/or modified sequence opt2 from hemagglutinin__InfluenzaA__ALA08634

SEQ ID NO: 104615 - RNA, 1701 nt, Artificial Sequence; identical to SEQ ID NO: 103953
  derived and/or modified sequence opt2 from hemagglutinin__InfluenzaA__ALA08635

SEQ ID NO: 104616 - RNA, 1701 nt, Artificial Sequence
  derived and/or modified sequence opt2 from hemagglutinin__InfluenzaA__ALA08636
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcauccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104617 - RNA, 1701 nt, Artificial Sequence; identical to SEQ ID NO: 104510
  derived and/or modified sequence opt2 from hemagglutinin__InfluenzaA__ALA08637

SEQ ID NO: 104618 - RNA, 1701 nt, Artificial Sequence
  derived and/or modified sequence opt2 from hemagglutinin__InfluenzaA__ALA08638
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104619 - RNA, 1701 nt, Artificial Sequence; identical to SEQ ID NO: 104510
  derived and/or modified sequence opt2 from hemagglutinin__InfluenzaA__ALA08639

SEQ ID NO: 104620 - RNA, 1701 nt, Artificial Sequence; identical to SEQ ID NO: 104510
  derived and/or modified sequence opt2 from hemagglutinin__InfluenzaA__ALA08640

SEQ ID NO: 104621 - RNA, 1701 nt, Artificial Sequence; identical to SEQ ID NO: 104510
  derived and/or modified sequence opt2 from hemagglutinin__InfluenzaA__ALA08641

SEQ ID NO: 104622 - RNA, 1701 nt, Artificial Sequence; identical to SEQ ID NO: 104510
  derived and/or modified sequence opt2 from hemagglutinin__InfluenzaA__ALA08642

SEQ ID NO: 104623 - RNA, 1701 nt, Artificial Sequence; identical to SEQ ID NO: 104510
  derived and/or modified sequence opt2 from hemagglutinin__InfluenzaA__ALA08643

SEQ ID NO: 104624 - RNA, 1701 nt, Artificial Sequence; identical to SEQ ID NO: 103953
  derived and/or modified sequence opt2 from hemagglutinin__InfluenzaA__ALA08644

SEQ ID NO: 104625 - RNA, 1701 nt, Artificial Sequence
  derived and/or modified sequence opt2 from hemagglutinin__InfluenzaA__ALA08645
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgacaucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104626 - RNA, 1701 nt, Artificial Sequence; identical to SEQ ID NO: 103953
  derived and/or modified sequence opt2 from hemagglutinin__InfluenzaA__ALA08646

SEQ ID NO: 104627 - RNA, 1701 nt, Artificial Sequence; identical to SEQ ID NO: 103953
  derived and/or modified sequence opt2 from hemagglutinin__InfluenzaA__ALA08647

SEQ ID NO: 104628 - RNA, 1701 nt, Artificial Sequence; identical to SEQ ID NO: 104510
  derived and/or modified sequence opt2 from hemagglutinin__InfluenzaA__ALA08648

SEQ ID NO: 104629 - RNA, 1701 nt, Artificial Sequence
  derived and/or modified sequence opt2 from hemagglutinin__InfluenzaA__ALA08650
augaagaccaucaucgcccucuccuacauccucugccucgucuucgcccagaagauccccggcaacgacaacuccaccgccacccucugccucggccaccacgccguccccaacggcaccaucgucaagaccaucaccaacgagcgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104630 - RNA, 1701 nt, Artificial Sequence; identical to SEQ ID NO: 104510
  derived and/or modified sequence opt2 from hemagglutinin__InfluenzaA__ALA08652

SEQ ID NO: 104631 - RNA, 1701 nt, Artificial Sequence; identical to SEQ ID NO: 103953
  derived and/or modified sequence opt2 from hemagglutinin__InfluenzaA__ALA08653

SEQ ID NO: 104632 - RNA, 1701 nt, Artificial Sequence
  derived and/or modified sequence opt2 from hemagglutinin__InfluenzaA__ALA08654
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaaguccugcuuccuccucugcgucgcccuccucggcuucaucaugugggccugccagaagggcaacauccgcugcaacaucugcaucuga

SEQ ID NO: 104633 - RNA, 1701 nt, Artificial Sequence; identical to SEQ ID NO: 104510
  derived and/or modified sequence opt2 from hemagglutinin__InfluenzaA__ALA08655

SEQ ID NO: 104634 - RNA, 1701 nt, Artificial Sequence; identical to SEQ ID NO: 104510
  derived and/or modified sequence opt2 from hemagglutinin__InfluenzaA__ALA08656

SEQ ID NO: 104635 - RNA, 1701 nt, Artificial Sequence
  derived and/or modified sequence opt2 from hemagglutinin__InfluenzaA__ALA08657
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104636 - RNA, 1701 nt, Artificial Sequence; identical to SEQ ID NO: 104510
  derived and/or modified sequence opt2 from hemagglutinin__InfluenzaA__ALA08658

SEQ ID NO: 104637 - RNA, 1701 nt, Artificial Sequence; identical to SEQ ID NO: 104497
  derived and/or modified sequence opt2 from hemagglutinin__InfluenzaA__ALA08659

SEQ ID NO: 104638 - RNA, 1701 nt, Artificial Sequence
  derived and/or modified sequence opt2 from hemagglutinin__InfluenzaA__ALA08660
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacggcacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104639 - RNA, 1701 nt, Artificial Sequence
  derived and/or modified sequence opt2 from hemagglutinin__InfluenzaA__ALA08662
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacuccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104640 - RNA, 1701 nt, Artificial Sequence; identical to SEQ ID NO: 104611
  derived and/or modified sequence opt2 from hemagglutinin__InfluenzaA__ALA08663

SEQ ID NO: 104641 - RNA, 1701 nt, Artificial Sequence; identical to SEQ ID NO: 104639
  derived and/or modified sequence opt2 from hemagglutinin__InfluenzaA__ALA08665

SEQ ID NO: 104642 - RNA, 1701 nt, Artificial Sequence
  derived and/or modified sequence opt2 from hemagglutinin__InfluenzaA__ALA08666
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 104643 - RNA, 1701 nt, Artificial Sequence
  derived and/or modified sequence opt2 from hemagglutinin__InfluenzaA__ALA08667
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104644 - RNA, 1701 nt, Artificial Sequence
  derived and/or modified sequence opt2 from hemagglutinin__InfluenzaA__ALA08668
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggccaucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104645 - RNA, 1701 nt, Artificial Sequence; identical to SEQ ID NO: 104611
  derived and/or modified sequence opt2 from hemagglutinin__InfluenzaA__ALA08669

SEQ ID NO: 104646 - RNA, 1701 nt, Artificial Sequence; identical to SEQ ID NO: 104504
  derived and/or modified sequence opt2 from hemagglutinin__InfluenzaA__ALA08670

SEQ ID NO: 104647 - RNA, 1701 nt, Artificial Sequence; identical to SEQ ID NO: 104611
  derived and/or modified sequence opt2 from hemagglutinin__InfluenzaA__ALA08671

SEQ ID NO: 104648 - RNA, 1701 nt, Artificial Sequence; identical to SEQ ID NO: 104611
  derived and/or modified sequence opt2 from hemagglutinin__InfluenzaA__ALA08672

SEQ ID NO: 104649 - RNA, 1701 nt, Artificial Sequence; identical to SEQ ID NO: 104504
  derived and/or modified sequence opt2 from hemagglutinin__InfluenzaA__ALA08673

SEQ ID NO: 104650 - RNA, 1701 nt, Artificial Sequence; identical to SEQ ID NO: 104611
  derived and/or modified sequence opt2 from hemagglutinin__InfluenzaA__ALA08674

SEQ ID NO: 104651 - RNA, 1701 nt, Artificial Sequence; identical to SEQ ID NO: 103953
  derived and/or modified sequence opt2 from hemagglutinin__InfluenzaA__ALA08675

SEQ ID NO: 104652 - RNA, 1701 nt, Artificial Sequence; identical to SEQ ID NO: 104611
  derived and/or modified sequence opt2 from hemagglutinin__InfluenzaA__ALA08676

SEQ ID NO: 104653 - RNA, 1701 nt, Artificial Sequence; identical to SEQ ID NO: 104611
  derived and/or modified sequence opt2 from hemagglutinin__InfluenzaA__ALA08677

SEQ ID NO: 104654 - RNA, 1701 nt, Artificial Sequence; identical to SEQ ID NO: 104611
  derived and/or modified sequence opt2 from hemagglutinin__InfluenzaA__ALA08678

SEQ ID NO: 104655 - RNA, 1701 nt, Artificial Sequence; identical to SEQ ID NO: 104611
  derived and/or modified sequence opt2 from hemagglutinin__InfluenzaA__ALA08679

SEQ ID NO: 104656 - RNA, 1701 nt, Artificial Sequence; identical to SEQ ID NO: 104611
  derived and/or modified sequence opt2 from hemagglutinin__InfluenzaA__ALA08680

SEQ ID NO: 104657 - RNA, 1701 nt, Artificial Sequence; identical to SEQ ID NO: 104510
  derived and/or modified sequence opt2 from hemagglutinin__InfluenzaA__ALA08681

SEQ ID NO: 104658 - RNA, 1701 nt, Artificial Sequence; identical to SEQ ID NO: 104589
  derived and/or modified sequence opt2 from hemagglutinin__InfluenzaA__ALA08682

SEQ ID NO: 104659 - RNA, 1701 nt, Artificial Sequence; identical to SEQ ID NO: 104510
  derived and/or modified sequence opt2 from hemagglutinin__InfluenzaA__ALA08683

SEQ ID NO: 104660 - RNA, 1701 nt, Artificial Sequence
  derived and/or modified sequence opt2 from hemagglutinin__InfluenzaA__ALA08684
augaagaccaucaucgcccucucccacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104661 - RNA, 1701 nt, Artificial Sequence; identical to SEQ ID NO: 103953
  derived and/or modified sequence opt2 from hemagglutinin__InfluenzaA__ALA08686

SEQ ID NO: 104662 - RNA, 1701 nt, Artificial Sequence
  derived and/or modified sequence opt2 from hemagglutinin__InfluenzaA__ALA08687
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104663 - RNA, 1701 nt, Artificial Sequence; identical to SEQ ID NO: 104604
  derived and/or modified sequence opt2 from hemagglutinin__InfluenzaA__ALA08688

SEQ ID NO: 104664 - RNA, 1701 nt, Artificial Sequence; identical to SEQ ID NO: 103953
  derived and/or modified sequence opt2 from hemagglutinin__InfluenzaA__ALE31612

SEQ ID NO: 104665 - RNA, 1701 nt, Artificial Sequence
  derived and/or modified sequence opt2 from hemagglutinin__InfluenzaA__ALE31613
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucuccuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 104666 - RNA, 1701 nt, Artificial Sequence
  derived and/or modified sequence opt2 from hemagglutinin__InfluenzaA__ALE31614
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcaagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104667 - RNA, 1701 nt, Artificial Sequence
  derived and/or modified sequence opt2 from hemagglutinin__InfluenzaA__ALE31615
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104668 - RNA, 1701 nt, Artificial Sequence; identical to SEQ ID NO: 103953
  derived and/or modified sequence opt2 from hemagglutinin__InfluenzaA__ALE31616

SEQ ID NO: 104669 - RNA, 1701 nt, Artificial Sequence; identical to SEQ ID NO: 103953
  derived and/or modified sequence opt2 from hemagglutinin__InfluenzaA__ALE31617

SEQ ID NO: 104670 - RNA, 1701 nt, Artificial Sequence; identical to SEQ ID NO: 103953
  derived and/or modified sequence opt2 from hemagglutinin__InfluenzaA__ALE31618

SEQ ID NO: 104671 - RNA, 1701 nt, Artificial Sequence; identical to SEQ ID NO: 104611
  derived and/or modified sequence opt2 from hemagglutinin__InfluenzaA__ALE31619

SEQ ID NO: 104672 - RNA, 1701 nt, Artificial Sequence; identical to SEQ ID NO: 103953
  derived and/or modified sequence opt2 from hemagglutinin__InfluenzaA__ALE31620

SEQ ID NO: 104673 - RNA, 1701 nt, Artificial Sequence
  derived and/or modified sequence opt2 from hemagglutinin__InfluenzaA__ALE31622
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacguccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104674 - RNA, 1701 nt, Artificial Sequence; identical to SEQ ID NO: 103953
  derived and/or modified sequence opt2 from hemagglutinin__InfluenzaA__ALE31623

SEQ ID NO: 104675 - RNA, 1701 nt, Artificial Sequence; identical to SEQ ID NO: 103953
  derived and/or modified sequence opt2 from hemagglutinin__InfluenzaA__ALE31625

SEQ ID NO: 104676 - RNA, 1701 nt, Artificial Sequence; identical to SEQ ID NO: 103953
  derived and/or modified sequence opt2 from hemagglutinin__InfluenzaA__ALE31626

SEQ ID NO: 104677 - RNA, 1701 nt, Artificial Sequence; identical to SEQ ID NO: 103953
  derived and/or modified sequence opt2 from hemagglutinin__InfluenzaA__ALE31627

SEQ ID NO: 104678 - RNA, 1701 nt, Artificial Sequence; identical to SEQ ID NO: 103953
  derived and/or modified sequence opt2 from hemagglutinin__InfluenzaA__ALE31628

SEQ ID NO: 104679 - RNA, 1701 nt, Artificial Sequence; identical to SEQ ID NO: 103953
  derived and/or modified sequence opt2 from hemagglutinin__InfluenzaA__ALE31629

SEQ ID NO: 104680 - RNA, 1701 nt, Artificial Sequence; identical to SEQ ID NO: 103953
  derived and/or modified sequence opt2 from hemagglutinin__InfluenzaA__ALE31632

SEQ ID NO: 104681 - RNA, 1701 nt, Artificial Sequence
  derived and/or modified sequence opt2 from hemagglutinin__InfluenzaA__ALE31634
augaagaccaucaucgcccucuccuacauccucugccucguccucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104682 - RNA, 1701 nt, Artificial Sequence; identical to SEQ ID NO: 103953
  derived and/or modified sequence opt2 from hemagglutinin__InfluenzaA__ALE31635

SEQ ID NO: 104683 - RNA, 1701 nt, Artificial Sequence; identical to SEQ ID NO: 103953
  derived and/or modified sequence opt2 from hemagglutinin__InfluenzaA__ALE31636

SEQ ID NO: 104684 - RNA, 1701 nt, Artificial Sequence
  derived and/or modified sequence opt2 from hemagglutinin__InfluenzaA__ALE31638
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacggcaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104685 - RNA, 1701 nt, Artificial Sequence; identical to SEQ ID NO: 103953
  derived and/or modified sequence opt2 from hemagglutinin__InfluenzaA__ALE31639

SEQ ID NO: 104686 - RNA, 1701 nt, Artificial Sequence; identical to SEQ ID NO: 104504
  derived and/or modified sequence opt2 from hemagglutinin__InfluenzaA__ALE31640

SEQ ID NO: 104687 - RNA, 1701 nt, Artificial Sequence; identical to SEQ ID NO: 104510
  derived and/or modified sequence opt2 from hemagglutinin__InfluenzaA__ALE31641

SEQ ID NO: 104688 - RNA, 1701 nt, Artificial Sequence; identical to SEQ ID NO: 104510
  derived and/or modified sequence opt2 from hemagglutinin__InfluenzaA__ALE31642

SEQ ID NO: 104689 - RNA, 1701 nt, Artificial Sequence
  derived and/or modified sequence opt2 from hemagglutinin__InfluenzaA__ALE31643
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaccgccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104690 - RNA, 1701 nt, Artificial Sequence; identical to SEQ ID NO: 103953
  derived and/or modified sequence opt2 from hemagglutinin__InfluenzaA__ALE31644

SEQ ID NO: 104691 - RNA, 1701 nt, Artificial Sequence; identical to SEQ ID NO: 103953
  derived and/or modified sequence opt2 from hemagglutinin__InfluenzaA__ALE31645

SEQ ID NO: 104692 - RNA, 1701 nt, Artificial Sequence; identical to SEQ ID NO: 103953
  derived and/or modified sequence opt2 from hemagglutinin__InfluenzaA__ALE31646

SEQ ID NO: 104693 - RNA, 1701 nt, Artificial Sequence; identical to SEQ ID NO: 104510
  derived and/or modified sequence opt2 from hemagglutinin__InfluenzaA__ALE31647

SEQ ID NO: 104694 - RNA, 1701 nt, Artificial Sequence
  derived and/or modified sequence opt2 from hemagglutinin__InfluenzaA__ALE31648
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaccgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104695 - RNA, 1701 nt, Artificial Sequence; identical to SEQ ID NO: 103953
  derived and/or modified sequence opt2 from hemagglutinin__InfluenzaA__ALE31649

SEQ ID NO: 104696 - RNA, 1701 nt, Artificial Sequence; identical to SEQ ID NO: 104510
  derived and/or modified sequence opt2 from hemagglutinin__InfluenzaA__ALE31650

SEQ ID NO: 104697 - RNA, 1701 nt, Artificial Sequence
  derived and/or modified sequence opt2 from hemagglutinin__InfluenzaA__ALE31652
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucucccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104698 - RNA, 1701 nt, Artificial Sequence; identical to SEQ ID NO: 104604
  derived and/or modified sequence opt2 from hemagglutinin__InfluenzaA__ALE31653

SEQ ID NO: 104699 - RNA, 1701 nt, Artificial Sequence; identical to SEQ ID NO: 103953
  derived and/or modified sequence opt2 from hemagglutinin__InfluenzaA__ALE31654

SEQ ID NO: 104700 - RNA, 1701 nt, Artificial Sequence; identical to SEQ ID NO: 103953
  derived and/or modified sequence opt2 from hemagglutinin__InfluenzaA__ALE31655

SEQ ID NO: 104701 - RNA, 1701 nt, Artificial Sequence
  derived and/or modified sequence opt2 from hemagglutinin__InfluenzaA__ALE31656
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggacaucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104702 - RNA, 1701 nt, Artificial Sequence
  derived and/or modified sequence opt2 from hemagglutinin__InfluenzaA__ALE31657
augaagaccaucaucgcccucuccuacauccucugccucgucuccgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104703 - RNA, 1701 nt, Artificial Sequence; identical to SEQ ID NO: 103953
  derived and/or modified sequence opt2 from hemagglutinin__InfluenzaA__ALE31658

SEQ ID NO: 104704 - RNA, 1701 nt, Artificial Sequence; identical to SEQ ID NO: 104568
  derived and/or modified sequence opt2 from hemagglutinin__InfluenzaA__ALE31659

SEQ ID NO: 104705 - RNA, 1701 nt, Artificial Sequence; identical to SEQ ID NO: 104497
  derived and/or modified sequence opt2 from hemagglutinin__InfluenzaA__ALE31660

SEQ ID NO: 104706 - RNA, 1701 nt, Artificial Sequence
  derived and/or modified sequence opt2 from hemagglutinin__InfluenzaA__ALE31661
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagaagucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104707 - RNA, 1701 nt, Artificial Sequence
  derived and/or modified sequence opt2 from hemagglutinin__InfluenzaA__ALE31662
augaagaccaucaucgcccucuccuacauccucugccucgucuucgcccagaagauccccggcaacgacaacuccaccgccacccucugccucggccaccacgccguccccaacggcaccaucgucaagaccaucgccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 104708 - RNA, 1701 nt, Artificial Sequence; identical to SEQ ID NO: 103939
  derived and/or modified sequence opt2 from hemagglutinin__InfluenzaA__ALE31663

SEQ ID NO: 104709 - RNA, 1701 nt, Artificial Sequence
  derived and/or modified sequence opt2 from hemagglutinin__InfluenzaA__ALE31666
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaaguacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104710 - RNA, 1701 nt, Artificial Sequence
  derived and/or modified sequence opt2 from hemagglutinin__InfluenzaA__ALE31667
augaagaccaucaucgcccucuccuacauccucugccucgucuucgcccagaagauccccggcaacgacaacuccaccgccacccucugccucggccaccacgccguccucaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104711 - RNA, 1701 nt, Artificial Sequence; identical to SEQ ID NO: 103953
  derived and/or modified sequence opt2 from hemagglutinin__InfluenzaA__ALE31668

SEQ ID NO: 104712 - RNA, 1701 nt, Artificial Sequence; identical to SEQ ID NO: 103953
  derived and/or modified sequence opt2 from hemagglutinin__InfluenzaA__ALE31669

SEQ ID NO: 104713 - RNA, 1701 nt, Artificial Sequence
  derived and/or modified sequence opt2 from hemagglutinin__InfluenzaA__ALE31670
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104714 - RNA, 1701 nt, Artificial Sequence; identical to SEQ ID NO: 103953
  derived and/or modified sequence opt2 from hemagglutinin__InfluenzaA__ALE31671

SEQ ID NO: 104715 - RNA, 1701 nt, Artificial Sequence; identical to SEQ ID NO: 103953
  derived and/or modified sequence opt2 from hemagglutinin__InfluenzaA__ALE31672

SEQ ID NO: 104716 - RNA, 1701 nt, Artificial Sequence; identical to SEQ ID NO: 104510
  derived and/or modified sequence opt2 from hemagglutinin__InfluenzaA__ALE31673

SEQ ID NO: 104717 - RNA, 1701 nt, Artificial Sequence
  derived and/or modified sequence opt2 from hemagglutinin__InfluenzaA__ALE31674
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccacuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104718 - RNA, 1701 nt, Artificial Sequence
  derived and/or modified sequence opt2 from hemagglutinin__InfluenzaA__ALE31675
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104719 - RNA, 1701 nt, Artificial Sequence
  derived and/or modified sequence opt2 from hemagglutinin__InfluenzaA__ALE31676
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgccccaagauccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacuccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104720 - RNA, 1701 nt, Artificial Sequence; identical to SEQ ID NO: 104611
  derived and/or modified sequence opt2 from hemagglutinin__InfluenzaA__ALE31677

SEQ ID NO: 104721 - RNA, 1701 nt, Artificial Sequence; identical to SEQ ID NO: 103953
  derived and/or modified sequence opt2 from hemagglutinin__InfluenzaA__ALE31678

SEQ ID NO: 104722 - RNA, 1701 nt, Artificial Sequence; identical to SEQ ID NO: 103953
  derived and/or modified sequence opt2 from hemagglutinin__InfluenzaA__ALE31679

SEQ ID NO: 104723 - RNA, 1701 nt, Artificial Sequence; identical to SEQ ID NO: 104569
  derived and/or modified sequence opt2 from hemagglutinin__InfluenzaA__ALE31680

SEQ ID NO: 104724 - RNA, 1701 nt, Artificial Sequence; identical to SEQ ID NO: 104568
  derived and/or modified sequence opt2 from hemagglutinin__InfluenzaA__ALE31681

SEQ ID NO: 104725 - RNA, 1701 nt, Artificial Sequence; identical to SEQ ID NO: 103953
  derived and/or modified sequence opt2 from hemagglutinin__InfluenzaA__ALE31682

SEQ ID NO: 104726 - RNA, 1701 nt, Artificial Sequence; identical to SEQ ID NO: 103953
  derived and/or modified sequence opt2 from hemagglutinin__InfluenzaA__ALE31683

SEQ ID NO: 104727 - RNA, 1701 nt, Artificial Sequence; identical to SEQ ID NO: 103953
  derived and/or modified sequence opt2 from hemagglutinin__InfluenzaA__ALE31684

SEQ ID NO: 104728 - RNA, 1701 nt, Artificial Sequence; identical to SEQ ID NO: 103953
  derived and/or modified sequence opt2 from hemagglutinin__InfluenzaA__ALE31685

SEQ ID NO: 104729 - RNA, 1701 nt, Artificial Sequence; identical to SEQ ID NO: 103953
  derived and/or modified sequence opt2 from hemagglutinin__InfluenzaA__ALE31686

SEQ ID NO: 104730 - RNA, 1701 nt, Artificial Sequence
  derived and/or modified sequence opt2 from hemagglutinin__InfluenzaA__ALE31687
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgaguccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104731 - RNA, 1701 nt, Artificial Sequence
  derived and/or modified sequence opt2 from hemagglutinin__InfluenzaA__ALE31688
augaagaccaccaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104732 - RNA, 1701 nt, Artificial Sequence; identical to SEQ ID NO: 103953
  derived and/or modified sequence opt2 from hemagglutinin__InfluenzaA__ALE31689

SEQ ID NO: 104733 - RNA, 1701 nt, Artificial Sequence
  derived and/or modified sequence opt2 from hemagglutinin__InfluenzaA__ALE31690
augaagaccaucaucgcccucuccugcauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104734 - RNA, 1701 nt, Artificial Sequence; identical to SEQ ID NO: 101506
  derived and/or modified sequence opt2 from hemagglutinin__InfluenzaA__ALE31691

SEQ ID NO: 104735 - RNA, 1701 nt, Artificial Sequence
  derived and/or modified sequence opt2 from hemagglutinin__InfluenzaA__ALE31692
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcuaccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104736 - RNA, 1701 nt, Artificial Sequence; identical to SEQ ID NO: 104735
  derived and/or modified sequence opt2 from hemagglutinin__InfluenzaA__ALE31693

SEQ ID NO: 104737 - RNA, 1701 nt, Artificial Sequence; identical to SEQ ID NO: 103953
  derived and/or modified sequence opt2 from hemagglutinin__InfluenzaA__ALE31694

SEQ ID NO: 104738 - RNA, 1701 nt, Artificial Sequence; identical to SEQ ID NO: 104735
  derived and/or modified sequence opt2 from hemagglutinin__InfluenzaA__ALE31695

SEQ ID NO: 104739 - RNA, 1701 nt, Artificial Sequence; identical to SEQ ID NO: 104611
  derived and/or modified sequence opt2 from hemagglutinin__InfluenzaA__ALE31696

SEQ ID NO: 104740 - RNA, 1701 nt, Artificial Sequence; identical to SEQ ID NO: 104735
  derived and/or modified sequence opt2 from hemagglutinin__InfluenzaA__ALE31697

SEQ ID NO: 104741 - RNA, 1701 nt, Artificial Sequence
  derived and/or modified sequence opt2 from hemagglutinin__InfluenzaA__ALE31698
augaagaccaucaucgcccucuccuacauccucugcauggucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104742 - RNA, 1701 nt, Artificial Sequence
  derived and/or modified sequence opt2 from hemagglutinin__InfluenzaA__ALE31699
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccaacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacgccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104743 - RNA, 1701 nt, Artificial Sequence; identical to SEQ ID NO: 103953
  derived and/or modified sequence opt2 from hemagglutinin__InfluenzaA__ALE31700

SEQ ID NO: 104744 - RNA, 1701 nt, Artificial Sequence; identical to SEQ ID NO: 103953
  derived and/or modified sequence opt2 from hemagglutinin__InfluenzaA__ALE31701

SEQ ID NO: 104745 - RNA, 1701 nt, Artificial Sequence; identical to SEQ ID NO: 104510
  derived and/or modified sequence opt2 from hemagglutinin__InfluenzaA__ALE31702

SEQ ID NO: 104746 - RNA, 1701 nt, Artificial Sequence; identical to SEQ ID NO: 103953
  derived and/or modified sequence opt2 from hemagglutinin__InfluenzaA__ALE31703

SEQ ID NO: 104747 - RNA, 1701 nt, Artificial Sequence; identical to SEQ ID NO: 103953
  derived and/or modified sequence opt2 from hemagglutinin__InfluenzaA__ALE31704

SEQ ID NO: 104748 - RNA, 1701 nt, Artificial Sequence; identical to SEQ ID NO: 104510
  derived and/or modified sequence opt2 from hemagglutinin__InfluenzaA__ALE31705

SEQ ID NO: 104749 - RNA, 1701 nt, Artificial Sequence
  derived and/or modified sequence opt2 from hemagglutinin__InfluenzaA__ALE31706
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 104750 - RNA, 1701 nt, Artificial Sequence; identical to SEQ ID NO: 104639
  derived and/or modified sequence opt2 from hemagglutinin__InfluenzaA__ALE31707

SEQ ID NO: 104751 - RNA, 1701 nt, Artificial Sequence; identical to SEQ ID NO: 104639
  derived and/or modified sequence opt2 from hemagglutinin__InfluenzaA__ALE31708

SEQ ID NO: 104752 - RNA, 1701 nt, Artificial Sequence; identical to SEQ ID NO: 103939
  derived and/or modified sequence opt2 from hemagglutinin__InfluenzaA__ALE31709

SEQ ID NO: 104753 - RNA, 1701 nt, Artificial Sequence
  derived and/or modified sequence opt2 from hemagglutinin__InfluenzaA__ALE31710
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgccuccgcauccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacuccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104754 - RNA, 1701 nt, Artificial Sequence; identical to SEQ ID NO: 104639
  derived and/or modified sequence opt2 from hemagglutinin__InfluenzaA__ALE31711

SEQ ID NO: 104755 - RNA, 1701 nt, Artificial Sequence; identical to SEQ ID NO: 104497
  derived and/or modified sequence opt2 from hemagglutinin__InfluenzaA__ALE31712

SEQ ID NO: 104756 - RNA, 1701 nt, Artificial Sequence
  derived and/or modified sequence opt2 from hemagglutinin__InfluenzaA__ALE31713
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcauccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacauccccgagaagcagaccaagggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 104757 - RNA, 1701 nt, Artificial Sequence; identical to SEQ ID NO: 104611
  derived and/or modified sequence opt2 from hemagglutinin__InfluenzaA__ALE31714

SEQ ID NO: 104758 - RNA, 1701 nt, Artificial Sequence; identical to SEQ ID NO: 104611
  derived and/or modified sequence opt2 from hemagglutinin__InfluenzaA__ALE31715

SEQ ID NO: 104759 - RNA, 1701 nt, Artificial Sequence; identical to SEQ ID NO: 104639
  derived and/or modified sequence opt2 from hemagglutinin__InfluenzaA__ALE31716

SEQ ID NO: 104760 - RNA, 1701 nt, Artificial Sequence
  derived and/or modified sequence opt2 from hemagglutinin__InfluenzaA__ALE31717
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagaccucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaccaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104761 - RNA, 1701 nt, Artificial Sequence; identical to SEQ ID NO: 104611
  derived and/or modified sequence opt2 from hemagglutinin__InfluenzaA__ALE31718

SEQ ID NO: 104762 - RNA, 1701 nt, Artificial Sequence
  derived and/or modified sequence opt2 from hemagglutinin__InfluenzaA__ALE31719
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104763 - RNA, 1701 nt, Artificial Sequence; identical to SEQ ID NO: 104497
  derived and/or modified sequence opt2 from hemagglutinin__InfluenzaA__ALE31720

SEQ ID NO: 104764 - RNA, 1701 nt, Artificial Sequence; identical to SEQ ID NO: 104510
  derived and/or modified sequence opt2 from hemagglutinin__InfluenzaA__ALE31721

SEQ ID NO: 104765 - RNA, 1701 nt, Artificial Sequence; identical to SEQ ID NO: 104733
  derived and/or modified sequence opt2 from hemagglutinin__InfluenzaA__ALE31722

SEQ ID NO: 104766 - RNA, 1701 nt, Artificial Sequence
  derived and/or modified sequence opt2 from hemagglutinin__InfluenzaA__ALE31723
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaccacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104767 - RNA, 1701 nt, Artificial Sequence; identical to SEQ ID NO: 103953
  derived and/or modified sequence opt2 from hemagglutinin__InfluenzaA__ALE31724

SEQ ID NO: 104768 - RNA, 1701 nt, Artificial Sequence; identical to SEQ ID NO: 103953
  derived and/or modified sequence opt2 from hemagglutinin__InfluenzaA__ALE31725

SEQ ID NO: 104769 - RNA, 1701 nt, Artificial Sequence; identical to SEQ ID NO: 103953
  derived and/or modified sequence opt2 from hemagglutinin__InfluenzaA__ALE31726

SEQ ID NO: 104770 - RNA, 1701 nt, Artificial Sequence; identical to SEQ ID NO: 103953
  derived and/or modified sequence opt2 from hemagglutinin__InfluenzaA__ALE31727

SEQ ID NO: 104771 - RNA, 1701 nt, Artificial Sequence
  derived and/or modified sequence opt2 from hemagglutinin__InfluenzaA__ALE31728
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccauccccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104772 - RNA, 1701 nt, Artificial Sequence
  derived and/or modified sequence opt2 from hemagglutinin__InfluenzaA__ALE31729
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104773 - RNA, 1701 nt, Artificial Sequence; identical to SEQ ID NO: 103953
  derived and/or modified sequence opt2 from hemagglutinin__InfluenzaA__ALE31730

SEQ ID NO: 104774 - RNA, 1701 nt, Artificial Sequence
  derived and/or modified sequence opt2 from hemagglutinin__InfluenzaA__ALE31731
augaagaccaucaucgcccucuccuacauccucugccaggucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104775 - RNA, 1701 nt, Artificial Sequence; identical to SEQ ID NO: 104611
  derived and/or modified sequence opt2 from hemagglutinin__InfluenzaA__ALE31732

SEQ ID NO: 104776 - RNA, 1701 nt, Artificial Sequence; identical to SEQ ID NO: 104611
  derived and/or modified sequence opt2 from hemagglutinin__InfluenzaA__ALE31733

SEQ ID NO: 104777 - RNA, 1701 nt, Artificial Sequence
  derived and/or modified sequence opt2 from hemagglutinin__InfluenzaA__ALE31734
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaaguacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcuuccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104778 - RNA, 1701 nt, Artificial Sequence; identical to SEQ ID NO: 104611
  derived and/or modified sequence opt2 from hemagglutinin__InfluenzaA__ALE31735

SEQ ID NO: 104779 - RNA, 1701 nt, Artificial Sequence; identical to SEQ ID NO: 104510
  derived and/or modified sequence opt2 from hemagglutinin__InfluenzaA__ALE31736

SEQ ID NO: 104780 - RNA, 1701 nt, Artificial Sequence; identical to SEQ ID NO: 104510
  derived and/or modified sequence opt2 from hemagglutinin__InfluenzaA__ALE31737

SEQ ID NO: 104781 - RNA, 1701 nt, Artificial Sequence
  derived and/or modified sequence opt2 from hemagglutinin__InfluenzaA__ALE31738
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104782 - RNA, 1701 nt, Artificial Sequence; identical to SEQ ID NO: 103953
  derived and/or modified sequence opt2 from hemagglutinin__InfluenzaA__ALE31739

SEQ ID NO: 104783 - RNA, 1701 nt, Artificial Sequence
  derived and/or modified sequence opt2 from hemagglutinin__InfluenzaA__ALE31741
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucuccgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104784 - RNA, 1701 nt, Artificial Sequence
  derived and/or modified sequence opt2 from hemagglutinin__InfluenzaA__ALE31742
augaagaccaucaucgcccucuccuacauccucugccucggcuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcgucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104785 - RNA, 1701 nt, Artificial Sequence; identical to SEQ ID NO: 104510
  derived and/or modified sequence opt2 from hemagglutinin__InfluenzaA__ALE31743

SEQ ID NO: 104786 - RNA, 1701 nt, Artificial Sequence; identical to SEQ ID NO: 103953
  derived and/or modified sequence opt2 from hemagglutinin__InfluenzaA__ALE31744

SEQ ID NO: 104787 - RNA, 1701 nt, Artificial Sequence
  derived and/or modified sequence opt2 from hemagglutinin__InfluenzaA__ALE31745
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgccuccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaacaagaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104788 - RNA, 1701 nt, Artificial Sequence
  derived and/or modified sequence opt2 from hemagglutinin__InfluenzaA__ALE31747
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcguccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104789 - RNA, 1701 nt, Artificial Sequence; identical to SEQ ID NO: 104510
  derived and/or modified sequence opt2 from hemagglutinin__InfluenzaA__ALE31748

SEQ ID NO: 104790 - RNA, 1701 nt, Artificial Sequence; identical to SEQ ID NO: 103953
  derived and/or modified sequence opt2 from hemagglutinin__InfluenzaA__ALE31749

SEQ ID NO: 104791 - RNA, 1701 nt, Artificial Sequence; identical to SEQ ID NO: 104497
  derived and/or modified sequence opt2 from hemagglutinin__InfluenzaA__ALE31750

SEQ ID NO: 104792 - RNA, 1701 nt, Artificial Sequence
  derived and/or modified sequence opt2 from hemagglutinin__InfluenzaA__ALE31751
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucgacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104793 - RNA, 1701 nt, Artificial Sequence; identical to SEQ ID NO: 103953
  derived and/or modified sequence opt2 from hemagglutinin__InfluenzaA__ALE31752

SEQ ID NO: 104794 - RNA, 1701 nt, Artificial Sequence; identical to SEQ ID NO: 104497
  derived and/or modified sequence opt2 from hemagglutinin__InfluenzaA__ALE31753

SEQ ID NO: 104795 - RNA, 1701 nt, Artificial Sequence; identical to SEQ ID NO: 103953
  derived and/or modified sequence opt2 from hemagglutinin__InfluenzaA__ALE31754

SEQ ID NO: 104796 - RNA, 1701 nt, Artificial Sequence
  derived and/or modified sequence opt2 from hemagglutinin__InfluenzaA__ALE31755
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccagaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104797 - RNA, 1701 nt, Artificial Sequence; identical to SEQ ID NO: 104497
  derived and/or modified sequence opt2 from hemagglutinin__InfluenzaA__ALE31756

SEQ ID NO: 104798 - RNA, 1701 nt, Artificial Sequence; identical to SEQ ID NO: 103953
  derived and/or modified sequence opt2 from hemagglutinin__InfluenzaA__ALE31757

SEQ ID NO: 104799 - RNA, 1701 nt, Artificial Sequence
  derived and/or modified sequence opt2 from hemagglutinin__InfluenzaA__ALE31758
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucgucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104800 - RNA, 1701 nt, Artificial Sequence
  derived and/or modified sequence opt2 from hemagglutinin__InfluenzaA__ALE31759
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcgucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacaacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104801 - RNA, 1701 nt, Artificial Sequence
  derived and/or modified sequence opt2 from hemagglutinin__InfluenzaA__ALE31760
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcuaccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacgccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104802 - RNA, 1701 nt, Artificial Sequence; identical to SEQ ID NO: 104497
  derived and/or modified sequence opt2 from hemagglutinin__InfluenzaA__ALE31761

SEQ ID NO: 104803 - RNA, 1701 nt, Artificial Sequence; identical to SEQ ID NO: 103953
  derived and/or modified sequence opt2 from hemagglutinin__InfluenzaA__ALE31762

SEQ ID NO: 104804 - RNA, 1701 nt, Artificial Sequence; identical to SEQ ID NO: 104559
  derived and/or modified sequence opt2 from hemagglutinin__InfluenzaA__ALE31763

SEQ ID NO: 104805 - RNA, 1701 nt, Artificial Sequence; identical to SEQ ID NO: 104611
  derived and/or modified sequence opt2 from hemagglutinin__InfluenzaA__ALE31764

SEQ ID NO: 104806 - RNA, 1701 nt, Artificial Sequence; identical to SEQ ID NO: 103953
  derived and/or modified sequence opt2 from hemagglutinin__InfluenzaA__ALE31765

SEQ ID NO: 104807 - RNA, 1701 nt, Artificial Sequence
  derived and/or modified sequence opt2 from hemagglutinin__InfluenzaA__ALE31774
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccaggucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104808 - RNA, 1701 nt, Artificial Sequence
  derived and/or modified sequence opt2 from hemagglutinin__InfluenzaA__ALE31775
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgaguuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104809 - RNA, 1701 nt, Artificial Sequence
  derived and/or modified sequence opt2 from hemagglutinin__InfluenzaA__ALE31776
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgccuccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104810 - RNA, 1701 nt, Artificial Sequence
  derived and/or modified sequence opt2 from hemagglutinin__InfluenzaA__ALE31777
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucguccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104811 - RNA, 1701 nt, Artificial Sequence; identical to SEQ ID NO: 104559
  derived and/or modified sequence opt2 from hemagglutinin__InfluenzaA__ALE31778

SEQ ID NO: 104812 - RNA, 1701 nt, Artificial Sequence; identical to SEQ ID NO: 103953
  derived and/or modified sequence opt2 from hemagglutinin__InfluenzaA__ALE31779

SEQ ID NO: 104813 - RNA, 1701 nt, Artificial Sequence
  derived and/or modified sequence opt2 from hemagglutinin__InfluenzaA__ALE31780
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcaccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104814 - RNA, 1701 nt, Artificial Sequence
  derived and/or modified sequence opt2 from hemagglutinin__InfluenzaA__ALE31781
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcggcuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucuccaagcucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104815 - RNA, 1701 nt, Artificial Sequence
  derived and/or modified sequence opt2 from hemagglutinin__InfluenzaA__ALE31782
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104816 - RNA, 1701 nt, Artificial Sequence
  derived and/or modified sequence opt2 from hemagglutinin__InfluenzaA__ALE31783
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccguccccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104817 - RNA, 1701 nt, Artificial Sequence; identical to SEQ ID NO: 104569
  derived and/or modified sequence opt2 from hemagglutinin__InfluenzaA__ALE31784

SEQ ID NO: 104818 - RNA, 1701 nt, Artificial Sequence; identical to SEQ ID NO: 103953
  derived and/or modified sequence opt2 from hemagglutinin__InfluenzaA__ALE31785

SEQ ID NO: 104819 - RNA, 1701 nt, Artificial Sequence; identical to SEQ ID NO: 104559
  derived and/or modified sequence opt2 from hemagglutinin__InfluenzaA__ALE31786

SEQ ID NO: 104820 - RNA, 1701 nt, Artificial Sequence; identical to SEQ ID NO: 104611
  derived and/or modified sequence opt2 from hemagglutinin__InfluenzaA__ALE31787

SEQ ID NO: 104821 - RNA, 1701 nt, Artificial Sequence; identical to SEQ ID NO: 104053
  derived and/or modified sequence opt2 from hemagglutinin__InfluenzaA__ALE31788

SEQ ID NO: 104822 - RNA, 1701 nt, Artificial Sequence; identical to SEQ ID NO: 103953
  derived and/or modified sequence opt2 from hemagglutinin__InfluenzaA__ALE31789

SEQ ID NO: 104823 - RNA, 1701 nt, Artificial Sequence; identical to SEQ ID NO: 104568
  derived and/or modified sequence opt2 from hemagglutinin__InfluenzaA__ALE31790

SEQ ID NO: 104824 - RNA, 1701 nt, Artificial Sequence; identical to SEQ ID NO: 104689
  derived and/or modified sequence opt2 from hemagglutinin__InfluenzaA__ALE31791

SEQ ID NO: 104825 - RNA, 1701 nt, Artificial Sequence; identical to SEQ ID NO: 104589
  derived and/or modified sequence opt2 from hemagglutinin__InfluenzaA__ALE31792

SEQ ID NO: 104826 - RNA, 1701 nt, Artificial Sequence
  derived and/or modified sequence opt2 from hemagglutinin__InfluenzaA__ALE31793
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucucccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104827 - RNA, 1701 nt, Artificial Sequence; identical to SEQ ID NO: 103953
  derived and/or modified sequence opt2 from hemagglutinin__InfluenzaA__ALE31794

SEQ ID NO: 104828 - RNA, 1701 nt, Artificial Sequence; identical to SEQ ID NO: 103953
  derived and/or modified sequence opt2 from hemagglutinin__InfluenzaA__ALE31795

SEQ ID NO: 104829 - RNA, 1701 nt, Artificial Sequence; identical to SEQ ID NO: 103953
  derived and/or modified sequence opt2 from hemagglutinin__InfluenzaA__ALE31796

SEQ ID NO: 104830 - RNA, 1701 nt, Artificial Sequence; identical to SEQ ID NO: 104611
  derived and/or modified sequence opt2 from hemagglutinin__InfluenzaA__ALE31797

SEQ ID NO: 104831 - RNA, 1701 nt, Artificial Sequence; identical to SEQ ID NO: 104611
  derived and/or modified sequence opt2 from hemagglutinin__InfluenzaA__ALE31798

SEQ ID NO: 104832 - RNA, 1701 nt, Artificial Sequence; identical to SEQ ID NO: 103953
  derived and/or modified sequence opt2 from hemagglutinin__InfluenzaA__ALE31799

SEQ ID NO: 104833 - RNA, 1701 nt, Artificial Sequence; identical to SEQ ID NO: 104559
  derived and/or modified sequence opt2 from hemagglutinin__InfluenzaA__ALE31800

SEQ ID NO: 104834 - RNA, 1701 nt, Artificial Sequence; identical to SEQ ID NO: 103953
  derived and/or modified sequence opt2 from hemagglutinin__InfluenzaA__ALE31801

SEQ ID NO: 104835 - RNA, 1701 nt, Artificial Sequence; identical to SEQ ID NO: 103953
  derived and/or modified sequence opt2 from hemagglutinin__InfluenzaA__ALE31802

SEQ ID NO: 104836 - RNA, 1701 nt, Artificial Sequence; identical to SEQ ID NO: 104559
  derived and/or modified sequence opt2 from hemagglutinin__InfluenzaA__ALE31803

SEQ ID NO: 104837 - RNA, 1701 nt, Artificial Sequence; identical to SEQ ID NO: 104510
  derived and/or modified sequence opt2 from hemagglutinin__InfluenzaA__ALE31805

SEQ ID NO: 104838 - RNA, 1701 nt, Artificial Sequence
  derived and/or modified sequence opt2 from hemagglutinin__InfluenzaA__ALE31806
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacacccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104839 - RNA, 1701 nt, Artificial Sequence
  derived and/or modified sequence opt2 from hemagglutinin__InfluenzaA__ALE31807
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuucaccuaccccgcccucaacgucaccaugcccaacaacgagcaguucgacaagcucuacgucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104840 - RNA, 1701 nt, Artificial Sequence
  derived and/or modified sequence opt2 from hemagglutinin__InfluenzaA__ALE31808
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104841 - RNA, 1701 nt, Artificial Sequence; identical to SEQ ID NO: 103953
  derived and/or modified sequence opt2 from hemagglutinin__InfluenzaA__ALE31810

SEQ ID NO: 104842 - RNA, 1701 nt, Artificial Sequence; identical to SEQ ID NO: 103953
  derived and/or modified sequence opt2 from hemagglutinin__InfluenzaA__ALE31812

SEQ ID NO: 104843 - RNA, 1701 nt, Artificial Sequence
  derived and/or modified sequence opt2 from hemagglutinin__InfluenzaA__ALE31814
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104844 - RNA, 1701 nt, Artificial Sequence; identical to SEQ ID NO: 104843
  derived and/or modified sequence opt2 from hemagglutinin__InfluenzaA__ALE31815

SEQ ID NO: 104845 - RNA, 1701 nt, Artificial Sequence; identical to SEQ ID NO: 103953
  derived and/or modified sequence opt2 from hemagglutinin__InfluenzaA__ALE31818

SEQ ID NO: 104846 - RNA, 1701 nt, Artificial Sequence
  derived and/or modified sequence opt2 from hemagglutinin__InfluenzaA__ALE31819
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccuccuccuccuucuucucccgccucaacuggcucacccaccucaacuacaccuaccccgcccucaacgucaccaugcccaacaaggagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104847 - RNA, 1701 nt, Artificial Sequence; identical to SEQ ID NO: 104497
  derived and/or modified sequence opt2 from hemagglutinin__InfluenzaA__ALE31820

SEQ ID NO: 104848 - RNA, 1701 nt, Artificial Sequence
  derived and/or modified sequence opt2 from hemagglutinin__InfluenzaA__ALE31821
augaagaccaucaucgcccucuccuacacccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104849 - RNA, 1701 nt, Artificial Sequence; identical to SEQ ID NO: 104589
  derived and/or modified sequence opt2 from hemagglutinin__InfluenzaA__ALE31822

SEQ ID NO: 104850 - RNA, 1701 nt, Artificial Sequence; identical to SEQ ID NO: 104497
  derived and/or modified sequence opt2 from hemagglutinin__InfluenzaA__ALE31823

SEQ ID NO: 104851 - RNA, 1701 nt, Artificial Sequence; identical to SEQ ID NO: 103953
  derived and/or modified sequence opt2 from hemagglutinin__InfluenzaA__ALE31824

SEQ ID NO: 104852 - RNA, 1701 nt, Artificial Sequence
  derived and/or modified sequence opt2 from hemagglutinin__InfluenzaA__ALE31825
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuaccgcuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104853 - RNA, 1701 nt, Artificial Sequence; identical to SEQ ID NO: 103953
  derived and/or modified sequence opt2 from hemagglutinin__InfluenzaA__ALE31826

SEQ ID NO: 104854 - RNA, 1701 nt, Artificial Sequence; identical to SEQ ID NO: 103953
  derived and/or modified sequence opt2 from hemagglutinin__InfluenzaA__ALE31827

SEQ ID NO: 104855 - RNA, 1701 nt, Artificial Sequence; identical to SEQ ID NO: 103953
  derived and/or modified sequence opt2 from hemagglutinin__InfluenzaA__ALE31828

SEQ ID NO: 104856 - RNA, 1701 nt, Artificial Sequence; identical to SEQ ID NO: 104510
  derived and/or modified sequence opt2 from hemagglutinin__InfluenzaA__ALE31829

SEQ ID NO: 104857 - RNA, 1701 nt, Artificial Sequence
  derived and/or modified sequence opt2 from hemagglutinin__InfluenzaA__ALE31830
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgacaucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104858 - RNA, 1701 nt, Artificial Sequence
  derived and/or modified sequence opt2 from hemagglutinin__InfluenzaA__ALE31832
augaagaacaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104859 - RNA, 1701 nt, Artificial Sequence
  derived and/or modified sequence opt2 from hemagglutinin__InfluenzaA__ALE31833
augaagaccaucaucgcccucuccuacauccucugccucgucuccgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104860 - RNA, 1701 nt, Artificial Sequence
  derived and/or modified sequence opt2 from hemagglutinin__InfluenzaA__ALE31834
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104861 - RNA, 1701 nt, Artificial Sequence; identical to SEQ ID NO: 104611
  derived and/or modified sequence opt2 from hemagglutinin__InfluenzaA__ALE31835

SEQ ID NO: 104862 - RNA, 1701 nt, Artificial Sequence; identical to SEQ ID NO: 103953
  derived and/or modified sequence opt2 from hemagglutinin__InfluenzaA__ALE31836

SEQ ID NO: 104863 - RNA, 1701 nt, Artificial Sequence
  derived and/or modified sequence opt2 from hemagglutinin__InfluenzaA__ALE31837
augaagaccaucaucgcccucuccuacauccucugccucgucuacgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104864 - RNA, 1701 nt, Artificial Sequence; identical to SEQ ID NO: 103953
  derived and/or modified sequence opt2 from hemagglutinin__InfluenzaA__ALE31838

SEQ ID NO: 104865 - RNA, 1701 nt, Artificial Sequence; identical to SEQ ID NO: 103953
  derived and/or modified sequence opt2 from hemagglutinin__InfluenzaA__ALE31839

SEQ ID NO: 104866 - RNA, 1701 nt, Artificial Sequence
  derived and/or modified sequence opt2 from hemagglutinin__InfluenzaA__ALE31840
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgccuccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104867 - RNA, 1701 nt, Artificial Sequence; identical to SEQ ID NO: 103953
  derived and/or modified sequence opt2 from hemagglutinin__InfluenzaA__ALE31842

SEQ ID NO: 104868 - RNA, 1701 nt, Artificial Sequence
  derived and/or modified sequence opt2 from hemagglutinin__InfluenzaA__ALE31843
augcagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104869 - RNA, 1701 nt, Artificial Sequence; identical to SEQ ID NO: 104510
  derived and/or modified sequence opt2 from hemagglutinin__InfluenzaA__ALE31844

SEQ ID NO: 104870 - RNA, 1701 nt, Artificial Sequence; identical to SEQ ID NO: 104486
  derived and/or modified sequence opt2 from hemagglutinin__InfluenzaA__ALE31846

SEQ ID NO: 104871 - RNA, 1701 nt, Artificial Sequence; identical to SEQ ID NO: 103953
  derived and/or modified sequence opt2 from hemagglutinin__InfluenzaA__ALE31847

SEQ ID NO: 104872 - RNA, 1701 nt, Artificial Sequence; identical to SEQ ID NO: 103953
  derived and/or modified sequence opt2 from hemagglutinin__InfluenzaA__ALE31848

SEQ ID NO: 104873 - RNA, 1701 nt, Artificial Sequence
  derived and/or modified sequence opt2 from hemagglutinin__InfluenzaA__ALE31850
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcgucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104874 - RNA, 1701 nt, Artificial Sequence
  derived and/or modified sequence opt2 from hemagglutinin__InfluenzaA__ALE31851
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaucggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104875 - RNA, 1701 nt, Artificial Sequence; identical to SEQ ID NO: 104497
  derived and/or modified sequence opt2 from hemagglutinin__InfluenzaA__ALE31852

SEQ ID NO: 104876 - RNA, 1701 nt, Artificial Sequence
  derived and/or modified sequence opt2 from hemagglutinin__InfluenzaA__ALE31853
augaagaccaucaucgcccucuccuacauccucugccucgucuucacccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104877 - RNA, 1701 nt, Artificial Sequence
  derived and/or modified sequence opt2 from hemagglutinin__InfluenzaA__ALE31854
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggccgcugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104878 - RNA, 1701 nt, Artificial Sequence; identical to SEQ ID NO: 104639
  derived and/or modified sequence opt2 from hemagglutinin__InfluenzaA__ALE31855

SEQ ID NO: 104879 - RNA, 1701 nt, Artificial Sequence; identical to SEQ ID NO: 103953
  derived and/or modified sequence opt2 from hemagglutinin__InfluenzaA__ALE31856

SEQ ID NO: 104880 - RNA, 1701 nt, Artificial Sequence; identical to SEQ ID NO: 103953
  derived and/or modified sequence opt2 from hemagglutinin__InfluenzaA__ALE31857

SEQ ID NO: 104881 - RNA, 1701 nt, Artificial Sequence
  derived and/or modified sequence opt2 from hemagglutinin__InfluenzaA__ALE31858
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaaguacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104882 - RNA, 1701 nt, Artificial Sequence
  derived and/or modified sequence opt2 from hemagglutinin__InfluenzaA__ALE31859
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcacccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacaugcuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104883 - RNA, 1701 nt, Artificial Sequence
  derived and/or modified sequence opt2 from hemagglutinin__InfluenzaA__ALE31860
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcaagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcgaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104884 - RNA, 1701 nt, Artificial Sequence; identical to SEQ ID NO: 103953
  derived and/or modified sequence opt2 from hemagglutinin__InfluenzaA__ALE31861

SEQ ID NO: 104885 - RNA, 1701 nt, Artificial Sequence
  derived and/or modified sequence opt2 from hemagglutinin__InfluenzaA__ALE31862
augaagaugaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgaguuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104886 - RNA, 1701 nt, Artificial Sequence; identical to SEQ ID NO: 104611
  derived and/or modified sequence opt2 from hemagglutinin__InfluenzaA__ALE31863

SEQ ID NO: 104887 - RNA, 1701 nt, Artificial Sequence; identical to SEQ ID NO: 104611
  derived and/or modified sequence opt2 from hemagglutinin__InfluenzaA__ALE31865

SEQ ID NO: 104888 - RNA, 1701 nt, Artificial Sequence; identical to SEQ ID NO: 104611
  derived and/or modified sequence opt2 from hemagglutinin__InfluenzaA__ALE31866

SEQ ID NO: 104889 - RNA, 1701 nt, Artificial Sequence
  derived and/or modified sequence opt2 from hemagglutinin__InfluenzaA__ALE31867
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaacggcaacauccgcugcaacaucugcaucuga

SEQ ID NO: 104890 - RNA, 1701 nt, Artificial Sequence; identical to SEQ ID NO: 103953
  derived and/or modified sequence opt2 from hemagglutinin__InfluenzaA__ALE31868

SEQ ID NO: 104891 - RNA, 1701 nt, Artificial Sequence; identical to SEQ ID NO: 104889
  derived and/or modified sequence opt2 from hemagglutinin__InfluenzaA__ALE31869

SEQ ID NO: 104892 - RNA, 1701 nt, Artificial Sequence; identical to SEQ ID NO: 104889
  derived and/or modified sequence opt2 from hemagglutinin__InfluenzaA__ALE31870

SEQ ID NO: 104893 - RNA, 1701 nt, Artificial Sequence
  derived and/or modified sequence opt2 from hemagglutinin__InfluenzaA__ALE31871
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104894 - RNA, 1701 nt, Artificial Sequence; identical to SEQ ID NO: 103939
  derived and/or modified sequence opt2 from hemagglutinin__InfluenzaA__ALE31872

SEQ ID NO: 104895 - RNA, 1701 nt, Artificial Sequence; identical to SEQ ID NO: 103953
  derived and/or modified sequence opt2 from hemagglutinin__InfluenzaA__ALE31873

SEQ ID NO: 104896 - RNA, 1701 nt, Artificial Sequence
  derived and/or modified sequence opt2 from hemagglutinin__InfluenzaA__ALE31874
augaagaccaucaucgcccucuccuacauccucugccucgucuucgcccagaagcuccccggcaacgacaacuccgccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104897 - RNA, 1701 nt, Artificial Sequence; identical to SEQ ID NO: 104896
  derived and/or modified sequence opt2 from hemagglutinin__InfluenzaA__ALE31875

SEQ ID NO: 104898 - RNA, 1701 nt, Artificial Sequence; identical to SEQ ID NO: 104896
  derived and/or modified sequence opt2 from hemagglutinin__InfluenzaA__ALE31876

SEQ ID NO: 104899 - RNA, 1701 nt, Artificial Sequence
  derived and/or modified sequence opt2 from hemagglutinin__InfluenzaA__ALE31877
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaucaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104900 - RNA, 1701 nt, Artificial Sequence; identical to SEQ ID NO: 103953
  derived and/or modified sequence opt2 from hemagglutinin__InfluenzaA__ALE31878

SEQ ID NO: 104901 - RNA, 1701 nt, Artificial Sequence; identical to SEQ ID NO: 103953
  derived and/or modified sequence opt2 from hemagglutinin__InfluenzaA__ALE31879

SEQ ID NO: 104902 - RNA, 1701 nt, Artificial Sequence; identical to SEQ ID NO: 103953
  derived and/or modified sequence opt2 from hemagglutinin__InfluenzaA__ALE31880

SEQ ID NO: 104903 - RNA, 1701 nt, Artificial Sequence
  derived and/or modified sequence opt2 from hemagglutinin__InfluenzaA__ALE31881
augaagaccaucaucgcccucucccacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucgucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104904 - RNA, 1701 nt, Artificial Sequence; identical to SEQ ID NO: 103953
  derived and/or modified sequence opt2 from hemagglutinin__InfluenzaA__ALE31882

SEQ ID NO: 104905 - RNA, 1701 nt, Artificial Sequence; identical to SEQ ID NO: 103953
  derived and/or modified sequence opt2 from hemagglutinin__InfluenzaA__ALE31888

SEQ ID NO: 104906 - RNA, 1701 nt, Artificial Sequence; identical to SEQ ID NO: 103953
  derived and/or modified sequence opt2 from hemagglutinin__InfluenzaA__ALE31889

SEQ ID NO: 104907 - RNA, 1701 nt, Artificial Sequence; identical to SEQ ID NO: 104611
  derived and/or modified sequence opt2 from hemagglutinin__InfluenzaA__ALE31890

SEQ ID NO: 104908 - RNA, 1701 nt, Artificial Sequence; identical to SEQ ID NO: 104611
  derived and/or modified sequence opt2 from hemagglutinin__InfluenzaA__ALE31891

SEQ ID NO: 104909 - RNA, 1701 nt, Artificial Sequence; identical to SEQ ID NO: 103953
  derived and/or modified sequence opt2 from hemagglutinin__InfluenzaA__ALE31892

SEQ ID NO: 104910 - RNA, 1701 nt, Artificial Sequence; identical to SEQ ID NO: 103953
  derived and/or modified sequence opt2 from hemagglutinin__InfluenzaA__ALE31893

SEQ ID NO: 104911 - RNA, 1701 nt, Artificial Sequence; identical to SEQ ID NO: 104559
  derived and/or modified sequence opt2 from hemagglutinin__InfluenzaA__ALE31894

SEQ ID NO: 104912 - RNA, 1701 nt, Artificial Sequence; identical to SEQ ID NO: 103939
  derived and/or modified sequence opt2 from hemagglutinin__InfluenzaA__ALE31895

SEQ ID NO: 104913 - RNA, 1701 nt, Artificial Sequence; identical to SEQ ID NO: 103953
  derived and/or modified sequence opt2 from hemagglutinin__InfluenzaA__ALE31896

SEQ ID NO: 104914 - RNA, 1701 nt, Artificial Sequence; identical to SEQ ID NO: 103953
  derived and/or modified sequence opt2 from hemagglutinin__InfluenzaA__ALE31897

SEQ ID NO: 104915 - RNA, 1701 nt, Artificial Sequence; identical to SEQ ID NO: 103953
  derived and/or modified sequence opt2 from hemagglutinin__InfluenzaA__ALE31898

SEQ ID NO: 104916 - RNA, 1701 nt, Artificial Sequence
  derived and/or modified sequence opt2 from hemagglutinin__InfluenzaA__ALE31899
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaugaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104917 - RNA, 1701 nt, Artificial Sequence; identical to SEQ ID NO: 104559
  derived and/or modified sequence opt2 from hemagglutinin__InfluenzaA__ALE31901

SEQ ID NO: 104918 - RNA, 1701 nt, Artificial Sequence
  derived and/or modified sequence opt2 from hemagglutinin__InfluenzaA__ALE31902
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104919 - RNA, 1701 nt, Artificial Sequence; identical to SEQ ID NO: 103953
  derived and/or modified sequence opt2 from hemagglutinin__InfluenzaA__ALE31903

SEQ ID NO: 104920 - RNA, 1701 nt, Artificial Sequence; identical to SEQ ID NO: 103953
  derived and/or modified sequence opt2 from hemagglutinin__InfluenzaA__ALE31904

SEQ ID NO: 104921 - RNA, 1701 nt, Artificial Sequence
  derived and/or modified sequence opt2 from hemagglutinin__InfluenzaA__ALE31905
augaagaccaucaucgcccucggcuacauccucugccucggcuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104922 - RNA, 1701 nt, Artificial Sequence; identical to SEQ ID NO: 103953
  derived and/or modified sequence opt2 from hemagglutinin__InfluenzaA__ALE31906

SEQ ID NO: 104923 - RNA, 1701 nt, Artificial Sequence
  derived and/or modified sequence opt2 from hemagglutinin__InfluenzaA__ALE31907
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaaguccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104924 - RNA, 1701 nt, Artificial Sequence; identical to SEQ ID NO: 103953
  derived and/or modified sequence opt2 from hemagglutinin__InfluenzaA__ALE31908

SEQ ID NO: 104925 - RNA, 1701 nt, Artificial Sequence
  derived and/or modified sequence opt2 from hemagglutinin__InfluenzaA__ALE31909
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaaguccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104926 - RNA, 1701 nt, Artificial Sequence; identical to SEQ ID NO: 103953
  derived and/or modified sequence opt2 from hemagglutinin__InfluenzaA__ALE31910

SEQ ID NO: 104927 - RNA, 1701 nt, Artificial Sequence; identical to SEQ ID NO: 104876
  derived and/or modified sequence opt2 from hemagglutinin__InfluenzaA__ALE31912

SEQ ID NO: 104928 - RNA, 1701 nt, Artificial Sequence
  derived and/or modified sequence opt2 from hemagglutinin__InfluenzaA__ALE31913
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgaguccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104929 - RNA, 1701 nt, Artificial Sequence; identical to SEQ ID NO: 103953
  derived and/or modified sequence opt2 from hemagglutinin__InfluenzaA__ALE31914

SEQ ID NO: 104930 - RNA, 1701 nt, Artificial Sequence
  derived and/or modified sequence opt2 from hemagglutinin__InfluenzaA__ALE31915
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaguacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104931 - RNA, 1701 nt, Artificial Sequence; identical to SEQ ID NO: 103953
  derived and/or modified sequence opt2 from hemagglutinin__InfluenzaA__ALE31916

SEQ ID NO: 104932 - RNA, 1701 nt, Artificial Sequence; identical to SEQ ID NO: 103953
  derived and/or modified sequence opt2 from hemagglutinin__InfluenzaA__ALE31917

SEQ ID NO: 104933 - RNA, 1701 nt, Artificial Sequence; identical to SEQ ID NO: 104486
  derived and/or modified sequence opt2 from hemagglutinin__InfluenzaA__ALE31918

SEQ ID NO: 104934 - RNA, 1701 nt, Artificial Sequence; identical to SEQ ID NO: 104611
  derived and/or modified sequence opt2 from hemagglutinin__InfluenzaA__ALE31920

SEQ ID NO: 104935 - RNA, 1701 nt, Artificial Sequence; identical to SEQ ID NO: 103953
  derived and/or modified sequence opt2 from hemagglutinin__InfluenzaA__ALE31921

SEQ ID NO: 104936 - RNA, 1701 nt, Artificial Sequence; identical to SEQ ID NO: 103953
  derived and/or modified sequence opt2 from hemagglutinin__InfluenzaA__ALE31922

SEQ ID NO: 104937 - RNA, 1701 nt, Artificial Sequence; identical to SEQ ID NO: 104497
  derived and/or modified sequence opt2 from hemagglutinin__InfluenzaA__ALE31923

SEQ ID NO: 104938 - RNA, 1701 nt, Artificial Sequence; identical to SEQ ID NO: 103953
  derived and/or modified sequence opt2 from hemagglutinin__InfluenzaA__ALE31924

SEQ ID NO: 104939 - RNA, 1701 nt, Artificial Sequence; identical to SEQ ID NO: 103953
  derived and/or modified sequence opt2 from hemagglutinin__InfluenzaA__ALE31925

SEQ ID NO: 104940 - RNA, 1701 nt, Artificial Sequence
  derived and/or modified sequence opt2 from hemagglutinin__InfluenzaA__ALE31926
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagggcuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104941 - RNA, 1701 nt, Artificial Sequence; identical to SEQ ID NO: 103953
  derived and/or modified sequence opt2 from hemagglutinin__InfluenzaA__ALE31927

SEQ ID NO: 104942 - RNA, 1701 nt, Artificial Sequence
  derived and/or modified sequence opt2 from hemagglutinin__InfluenzaA__ALE31928
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104943 - RNA, 1701 nt, Artificial Sequence; identical to SEQ ID NO: 104589
  derived and/or modified sequence opt2 from hemagglutinin__InfluenzaA__ALE31930

SEQ ID NO: 104944 - RNA, 1701 nt, Artificial Sequence; identical to SEQ ID NO: 103953
  derived and/or modified sequence opt2 from hemagglutinin__InfluenzaA__ALE31931

SEQ ID NO: 104945 - RNA, 1701 nt, Artificial Sequence; identical to SEQ ID NO: 103953
  derived and/or modified sequence opt2 from hemagglutinin__InfluenzaA__ALE31932

SEQ ID NO: 104946 - RNA, 1701 nt, Artificial Sequence
  derived and/or modified sequence opt2 from hemagglutinin__InfluenzaA__ALE31933
augaagaccaucaucgcccucuccuacauccucugccucgucuacgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaaguacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104947 - RNA, 1701 nt, Artificial Sequence
  derived and/or modified sequence opt2 from hemagglutinin__InfluenzaA__ALE31934
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccaggcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104948 - RNA, 1701 nt, Artificial Sequence; identical to SEQ ID NO: 103953
  derived and/or modified sequence opt2 from hemagglutinin__InfluenzaA__ALE31935

SEQ ID NO: 104949 - RNA, 1701 nt, Artificial Sequence; identical to SEQ ID NO: 104735
  derived and/or modified sequence opt2 from hemagglutinin__InfluenzaA__ALE31936

SEQ ID NO: 104950 - RNA, 1701 nt, Artificial Sequence
  derived and/or modified sequence opt2 from hemagglutinin__InfluenzaA__ALE31937
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104951 - RNA, 1701 nt, Artificial Sequence; identical to SEQ ID NO: 103953
  derived and/or modified sequence opt2 from hemagglutinin__InfluenzaA__ALE31938

SEQ ID NO: 104952 - RNA, 1701 nt, Artificial Sequence; identical to SEQ ID NO: 104559
  derived and/or modified sequence opt2 from hemagglutinin__InfluenzaA__ALE31939

SEQ ID NO: 104953 - RNA, 1701 nt, Artificial Sequence; identical to SEQ ID NO: 103953
  derived and/or modified sequence opt2 from hemagglutinin__InfluenzaA__ALE31941

SEQ ID NO: 104954 - RNA, 1701 nt, Artificial Sequence; identical to SEQ ID NO: 104510
  derived and/or modified sequence opt2 from hemagglutinin__InfluenzaA__ALE31943

SEQ ID NO: 104955 - RNA, 1701 nt, Artificial Sequence
  derived and/or modified sequence opt2 from hemagglutinin__InfluenzaA__ALE31944
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104956 - RNA, 1701 nt, Artificial Sequence
  derived and/or modified sequence opt2 from hemagglutinin__InfluenzaA__ALE31945
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacgucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggacaucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104957 - RNA, 1701 nt, Artificial Sequence; identical to SEQ ID NO: 104611
  derived and/or modified sequence opt2 from hemagglutinin__InfluenzaA__ALE31946

SEQ ID NO: 104958 - RNA, 1701 nt, Artificial Sequence; identical to SEQ ID NO: 104611
  derived and/or modified sequence opt2 from hemagglutinin__InfluenzaA__ALE31947

SEQ ID NO: 104959 - RNA, 1701 nt, Artificial Sequence
  derived and/or modified sequence opt2 from hemagglutinin__InfluenzaA__ALE31948
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucgucggcaagaccaacgagaaguuccaccagaucgagaaggaguucuccgaggucgagggccgcauccaggaccucgagaaguacgucgaggacaccaagaucgaccucugguccuacaacgccgaguuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104960 - RNA, 1701 nt, Artificial Sequence; identical to SEQ ID NO: 104611
  derived and/or modified sequence opt2 from hemagglutinin__InfluenzaA__ALE31949

SEQ ID NO: 104961 - RNA, 1701 nt, Artificial Sequence; identical to SEQ ID NO: 103953
  derived and/or modified sequence opt2 from hemagglutinin__InfluenzaA__ALE31950

SEQ ID NO: 104962 - RNA, 1701 nt, Artificial Sequence; identical to SEQ ID NO: 104497
  derived and/or modified sequence opt2 from hemagglutinin__InfluenzaA__ALE31951

SEQ ID NO: 104963 - RNA, 1701 nt, Artificial Sequence; identical to SEQ ID NO: 103953
  derived and/or modified sequence opt2 from hemagglutinin__InfluenzaA__ALE31952

SEQ ID NO: 104964 - RNA, 1701 nt, Artificial Sequence
  derived and/or modified sequence opt2 from hemagglutinin__InfluenzaA__ALE31953
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuucgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104965 - RNA, 1701 nt, Artificial Sequence
  derived and/or modified sequence opt2 from hemagglutinin__InfluenzaA__ALE31954
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccacuccuccggccgcaucaccgucuccaccaagcgcucccagcaggccgucauccccaacgucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucgucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104966 - RNA, 1701 nt, Artificial Sequence; identical to SEQ ID NO: 103953
  derived and/or modified sequence opt2 from hemagglutinin__InfluenzaA__ALE31955

SEQ ID NO: 104967 - RNA, 1701 nt, Artificial Sequence
  derived and/or modified sequence opt2 from hemagglutinin__InfluenzaA__ALE31956
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104968 - RNA, 1701 nt, Artificial Sequence; identical to SEQ ID NO: 104559
  derived and/or modified sequence opt2 from hemagglutinin__InfluenzaA__ALE31957

SEQ ID NO: 104969 - RNA, 1701 nt, Artificial Sequence
  derived and/or modified sequence opt2 from hemagglutinin__InfluenzaA__ALE31958
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcuccaagccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104970 - RNA, 1701 nt, Artificial Sequence
  derived and/or modified sequence opt2 from hemagglutinin__InfluenzaA__ALE31959
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacgccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104971 - RNA, 1701 nt, Artificial Sequence; identical to SEQ ID NO: 103953
  derived and/or modified sequence opt2 from hemagglutinin__InfluenzaA__ALE31960

SEQ ID NO: 104972 - RNA, 1701 nt, Artificial Sequence; identical to SEQ ID NO: 104142
  derived and/or modified sequence opt2 from hemagglutinin__InfluenzaA__ALE31961

SEQ ID NO: 104973 - RNA, 1701 nt, Artificial Sequence
  derived and/or modified sequence opt2 from hemagglutinin__InfluenzaA__ALE31962
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcauguccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104974 - RNA, 1701 nt, Artificial Sequence
  derived and/or modified sequence opt2 from hemagglutinin__InfluenzaA__ALE31963
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaccuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104975 - RNA, 1701 nt, Artificial Sequence
  derived and/or modified sequence opt2 from hemagglutinin__InfluenzaA__ALE31964
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacuacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104976 - RNA, 1701 nt, Artificial Sequence; identical to SEQ ID NO: 103953
  derived and/or modified sequence opt2 from hemagglutinin__InfluenzaA__ALE31965

SEQ ID NO: 104977 - RNA, 1701 nt, Artificial Sequence; identical to SEQ ID NO: 104611
  derived and/or modified sequence opt2 from hemagglutinin__InfluenzaA__ALE31966

SEQ ID NO: 104978 - RNA, 1701 nt, Artificial Sequence; identical to SEQ ID NO: 104881
  derived and/or modified sequence opt2 from hemagglutinin__InfluenzaA__ALE31967

SEQ ID NO: 104979 - RNA, 1701 nt, Artificial Sequence; identical to SEQ ID NO: 104497
  derived and/or modified sequence opt2 from hemagglutinin__InfluenzaA__ALE31968

SEQ ID NO: 104980 - RNA, 1701 nt, Artificial Sequence; identical to SEQ ID NO: 104604
  derived and/or modified sequence opt2 from hemagglutinin__InfluenzaA__ALE31969

SEQ ID NO: 104981 - RNA, 1701 nt, Artificial Sequence; identical to SEQ ID NO: 103953
  derived and/or modified sequence opt2 from hemagglutinin__InfluenzaA__ALE31970

SEQ ID NO: 104982 - RNA, 1701 nt, Artificial Sequence
  derived and/or modified sequence opt2 from hemagglutinin__InfluenzaA__ALE31971
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacgccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104983 - RNA, 1701 nt, Artificial Sequence; identical to SEQ ID NO: 104497
  derived and/or modified sequence opt2 from hemagglutinin__InfluenzaA__ALE31972

SEQ ID NO: 104984 - RNA, 1701 nt, Artificial Sequence; identical to SEQ ID NO: 104497
  derived and/or modified sequence opt2 from hemagglutinin__InfluenzaA__ALE31973

SEQ ID NO: 104985 - RNA, 1701 nt, Artificial Sequence; identical to SEQ ID NO: 104142
  derived and/or modified sequence opt2 from hemagglutinin__InfluenzaA__ALE31974

SEQ ID NO: 104986 - RNA, 1701 nt, Artificial Sequence; identical to SEQ ID NO: 104497
  derived and/or modified sequence opt2 from hemagglutinin__InfluenzaA__ALE31975

SEQ ID NO: 104987 - RNA, 1701 nt, Artificial Sequence; identical to SEQ ID NO: 103953
  derived and/or modified sequence opt2 from hemagglutinin__InfluenzaA__ALE31976

SEQ ID NO: 104988 - RNA, 1701 nt, Artificial Sequence; identical to SEQ ID NO: 103953
  derived and/or modified sequence opt2 from hemagglutinin__InfluenzaA__ALE31977

SEQ ID NO: 104989 - RNA, 1701 nt, Artificial Sequence
  derived and/or modified sequence opt2 from hemagglutinin__InfluenzaA__ALE31978
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucauccacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104990 - RNA, 1701 nt, Artificial Sequence; identical to SEQ ID NO: 103953
  derived and/or modified sequence opt2 from hemagglutinin__InfluenzaA__ALE31979

SEQ ID NO: 104991 - RNA, 1701 nt, Artificial Sequence
  derived and/or modified sequence opt2 from hemagglutinin__InfluenzaA__ALE31980
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccgaguacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104992 - RNA, 1701 nt, Artificial Sequence; identical to SEQ ID NO: 103953
  derived and/or modified sequence opt2 from hemagglutinin__InfluenzaA__ALE31981

SEQ ID NO: 104993 - RNA, 1701 nt, Artificial Sequence; identical to SEQ ID NO: 104493
  derived and/or modified sequence opt2 from hemagglutinin__InfluenzaA__ALE31995

SEQ ID NO: 104994 - RNA, 1701 nt, Artificial Sequence
  derived and/or modified sequence opt2 from hemagglutinin__InfluenzaA__ALE31996
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcgucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104995 - RNA, 1701 nt, Artificial Sequence
  derived and/or modified sequence opt2 from hemagglutinin__InfluenzaA__ALE31997
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104996 - RNA, 1701 nt, Artificial Sequence; identical to SEQ ID NO: 103953
  derived and/or modified sequence opt2 from hemagglutinin__InfluenzaA__ALE31998

SEQ ID NO: 104997 - RNA, 1701 nt, Artificial Sequence
  derived and/or modified sequence opt2 from hemagglutinin__InfluenzaA__ALE31999
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccuccacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104998 - RNA, 1701 nt, Artificial Sequence
  derived and/or modified sequence opt2 from hemagglutinin__InfluenzaA__ALE32000
augaagaccaucaucgcccucucccacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104999 - RNA, 1701 nt, Artificial Sequence; identical to SEQ ID NO: 103953
  derived and/or modified sequence opt2 from hemagglutinin__InfluenzaA__ALE32001

SEQ ID NO: 105000 - RNA, 1701 nt, Artificial Sequence; identical to SEQ ID NO: 103953
  derived and/or modified sequence opt2 from hemagglutinin__InfluenzaA__ALE32002

SEQ ID NO: 105001 - RNA, 1701 nt, Artificial Sequence; identical to SEQ ID NO: 104053
  derived and/or modified sequence opt2 from hemagglutinin__InfluenzaA__ALE32003

SEQ ID NO: 105002 - RNA, 1701 nt, Artificial Sequence; identical to SEQ ID NO: 103953
  derived and/or modified sequence opt2 from hemagglutinin__InfluenzaA__ALE32004

SEQ ID NO: 105003 - RNA, 1701 nt, Artificial Sequence; identical to SEQ ID NO: 103953
  derived and/or modified sequence opt2 from hemagglutinin__InfluenzaA__ALE32005

SEQ ID NO: 105004 - RNA, 1701 nt, Artificial Sequence; identical to SEQ ID NO: 104497
  derived and/or modified sequence opt2 from hemagglutinin__InfluenzaA__ALE32006

SEQ ID NO: 105005 - RNA, 1701 nt, Artificial Sequence; identical to SEQ ID NO: 103953
  derived and/or modified sequence opt2 from hemagglutinin__InfluenzaA__ALE32007

SEQ ID NO: 105006 - RNA, 1701 nt, Artificial Sequence; identical to SEQ ID NO: 104504
  derived and/or modified sequence opt2 from hemagglutinin__InfluenzaA__ALE32008

SEQ ID NO: 105007 - RNA, 1701 nt, Artificial Sequence
  derived and/or modified sequence opt2 from hemagglutinin__InfluenzaA__ALE32009
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucguccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccaggagggcaacauccgcugcaacaucugcaucuga

SEQ ID NO: 105008 - RNA, 1701 nt, Artificial Sequence
  derived and/or modified sequence opt2 from hemagglutinin__InfluenzaA__ALE32010
augaagaccaucaucgcccucuccuacauccucugccucgccuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccuccacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105009 - RNA, 1701 nt, Artificial Sequence; identical to SEQ ID NO: 104967
  derived and/or modified sequence opt2 from hemagglutinin__InfluenzaA__ALE32011

SEQ ID NO: 105010 - RNA, 1701 nt, Artificial Sequence; identical to SEQ ID NO: 104510
  derived and/or modified sequence opt2 from hemagglutinin__InfluenzaA__ALE32012

SEQ ID NO: 105011 - RNA, 1701 nt, Artificial Sequence; identical to SEQ ID NO: 103953
  derived and/or modified sequence opt2 from hemagglutinin__InfluenzaA__ALE32013

SEQ ID NO: 105012 - RNA, 1701 nt, Artificial Sequence
  derived and/or modified sequence opt2 from hemagglutinin__InfluenzaA__ALE32014
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccagcucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105013 - RNA, 1701 nt, Artificial Sequence; identical to SEQ ID NO: 104838
  derived and/or modified sequence opt2 from hemagglutinin__InfluenzaA__ALE32015

SEQ ID NO: 105014 - RNA, 1701 nt, Artificial Sequence; identical to SEQ ID NO: 103953
  derived and/or modified sequence opt2 from hemagglutinin__InfluenzaA__ALE32016

SEQ ID NO: 105015 - RNA, 1701 nt, Artificial Sequence; identical to SEQ ID NO: 103953
  derived and/or modified sequence opt2 from hemagglutinin__InfluenzaA__ALE32017

SEQ ID NO: 105016 - RNA, 1701 nt, Artificial Sequence; identical to SEQ ID NO: 103953
  derived and/or modified sequence opt2 from hemagglutinin__InfluenzaA__ALE32018

SEQ ID NO: 105017 - RNA, 1701 nt, Artificial Sequence; identical to SEQ ID NO: 104497
  derived and/or modified sequence opt2 from hemagglutinin__InfluenzaA__ALE32020

SEQ ID NO: 105018 - RNA, 1701 nt, Artificial Sequence; identical to SEQ ID NO: 104604
  derived and/or modified sequence opt2 from hemagglutinin__InfluenzaA__ALE32021

SEQ ID NO: 105019 - RNA, 1701 nt, Artificial Sequence; identical to SEQ ID NO: 104684
  derived and/or modified sequence opt2 from hemagglutinin__InfluenzaA__ALE32022

SEQ ID NO: 105020 - RNA, 1701 nt, Artificial Sequence; identical to SEQ ID NO: 103953
  derived and/or modified sequence opt2 from hemagglutinin__InfluenzaA__ALE32023

SEQ ID NO: 105021 - RNA, 1701 nt, Artificial Sequence
  derived and/or modified sequence opt2 from hemagglutinin__InfluenzaA__ALE32024
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaaguccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccacuccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcaccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105022 - RNA, 1701 nt, Artificial Sequence
  derived and/or modified sequence opt2 from hemagglutinin__InfluenzaA__ALE32025
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaaguccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105023 - RNA, 1701 nt, Artificial Sequence; identical to SEQ ID NO: 103953
  derived and/or modified sequence opt2 from hemagglutinin__InfluenzaA__ALE32026

SEQ ID NO: 105024 - RNA, 1701 nt, Artificial Sequence; identical to SEQ ID NO: 104497
  derived and/or modified sequence opt2 from hemagglutinin__InfluenzaA__ALE32027

SEQ ID NO: 105025 - RNA, 1701 nt, Artificial Sequence
  derived and/or modified sequence opt2 from hemagglutinin__InfluenzaA__ALE32028
augaagaccaucaucgcccucucccacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105026 - RNA, 1701 nt, Artificial Sequence; identical to SEQ ID NO: 104604
  derived and/or modified sequence opt2 from hemagglutinin__InfluenzaA__ALE32029

SEQ ID NO: 105027 - RNA, 1701 nt, Artificial Sequence
  derived and/or modified sequence opt2 from hemagglutinin__InfluenzaA__ALE32030
augaagaccaucaucgcccucucccacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaucuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105028 - RNA, 1701 nt, Artificial Sequence
  derived and/or modified sequence opt2 from hemagglutinin__InfluenzaA__ALE32031
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105029 - RNA, 1701 nt, Artificial Sequence
  derived and/or modified sequence opt2 from hemagglutinin__InfluenzaA__ALE32032
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucgccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105030 - RNA, 1701 nt, Artificial Sequence; identical to SEQ ID NO: 103953
  derived and/or modified sequence opt2 from hemagglutinin__InfluenzaA__ALE32033

SEQ ID NO: 105031 - RNA, 1701 nt, Artificial Sequence
  derived and/or modified sequence opt2 from hemagglutinin__InfluenzaA__ALE32034
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaaguacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105032 - RNA, 1701 nt, Artificial Sequence; identical to SEQ ID NO: 104843
  derived and/or modified sequence opt2 from hemagglutinin__InfluenzaA__ALE32035

SEQ ID NO: 105033 - RNA, 1701 nt, Artificial Sequence
  derived and/or modified sequence opt2 from hemagglutinin__InfluenzaA__ALE32036
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccuccacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105034 - RNA, 1701 nt, Artificial Sequence
  derived and/or modified sequence opt2 from hemagglutinin__InfluenzaA__ALE32037
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105035 - RNA, 1701 nt, Artificial Sequence
  derived and/or modified sequence opt2 from hemagglutinin__InfluenzaA__ALE32038
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaagggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccucaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105036 - RNA, 1701 nt, Artificial Sequence; identical to SEQ ID NO: 104611
  derived and/or modified sequence opt2 from hemagglutinin__InfluenzaA__ALE32039

SEQ ID NO: 105037 - RNA, 1701 nt, Artificial Sequence
  derived and/or modified sequence opt2 from hemagglutinin__InfluenzaA__ALE32040
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaccuccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105038 - RNA, 1701 nt, Artificial Sequence; identical to SEQ ID NO: 103953
  derived and/or modified sequence opt2 from hemagglutinin__InfluenzaA__ALE32041

SEQ ID NO: 105039 - RNA, 1701 nt, Artificial Sequence; identical to SEQ ID NO: 103953
  derived and/or modified sequence opt2 from hemagglutinin__InfluenzaA__ALE32042

SEQ ID NO: 105040 - RNA, 1701 nt, Artificial Sequence
  derived and/or modified sequence opt2 from hemagglutinin__InfluenzaA__ALE32043
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacaccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105041 - RNA, 1701 nt, Artificial Sequence; identical to SEQ ID NO: 103953
  derived and/or modified sequence opt2 from hemagglutinin__InfluenzaA__ALE32044

SEQ ID NO: 105042 - RNA, 1701 nt, Artificial Sequence; identical to SEQ ID NO: 103953
  derived and/or modified sequence opt2 from hemagglutinin__InfluenzaA__ALE32045

SEQ ID NO: 105043 - RNA, 1701 nt, Artificial Sequence; identical to SEQ ID NO: 103953
  derived and/or modified sequence opt2 from hemagglutinin__InfluenzaA__ALE32046

SEQ ID NO: 105044 - RNA, 1701 nt, Artificial Sequence
  derived and/or modified sequence opt2 from hemagglutinin__InfluenzaA__ALE32047
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugaucuccgacgcccccaucggcaagugcaaguccgagugcaucacccccaacggcuccauccccuccgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105045 - RNA, 1701 nt, Artificial Sequence; identical to SEQ ID NO: 103953
  derived and/or modified sequence opt2 from hemagglutinin__InfluenzaA__ALE32048

SEQ ID NO: 105046 - RNA, 1701 nt, Artificial Sequence; identical to SEQ ID NO: 104611
  derived and/or modified sequence opt2 from hemagglutinin__InfluenzaA__ALE32049

SEQ ID NO: 105047 - RNA, 1701 nt, Artificial Sequence
  derived and/or modified sequence opt2 from hemagglutinin__InfluenzaA__ALE32050
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105048 - RNA, 1701 nt, Artificial Sequence
  derived and/or modified sequence opt2 from hemagglutinin__InfluenzaA__ALE32051
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcgucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaucaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105049 - RNA, 1701 nt, Artificial Sequence; identical to SEQ ID NO: 103953
  derived and/or modified sequence opt2 from hemagglutinin__InfluenzaA__ALE32052

SEQ ID NO: 105050 - RNA, 1701 nt, Artificial Sequence; identical to SEQ ID NO: 103953
  derived and/or modified sequence opt2 from hemagglutinin__InfluenzaA__ALE32053

SEQ ID NO: 105051 - RNA, 1701 nt, Artificial Sequence
  derived and/or modified sequence opt2 from hemagglutinin__InfluenzaA__ALE32054
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgaguccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaaccacugcaucuga

SEQ ID NO: 105052 - RNA, 1701 nt, Artificial Sequence
  derived and/or modified sequence opt2 from hemagglutinin__InfluenzaA__ALE32055
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaacggcaacauccgcugcaacaucugcaucuga

SEQ ID NO: 105053 - RNA, 1701 nt, Artificial Sequence; identical to SEQ ID NO: 104604
  derived and/or modified sequence opt2 from hemagglutinin__InfluenzaA__ALE32056

SEQ ID NO: 105054 - RNA, 1701 nt, Artificial Sequence
  derived and/or modified sequence opt2 from hemagglutinin__InfluenzaA__ALE32057
augaagaccaucaucgcccucuccuacguccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105055 - RNA, 1701 nt, Artificial Sequence; identical to SEQ ID NO: 103953
  derived and/or modified sequence opt2 from hemagglutinin__InfluenzaA__ALE32058

SEQ ID NO: 105056 - RNA, 1701 nt, Artificial Sequence; identical to SEQ ID NO: 103953
  derived and/or modified sequence opt2 from hemagglutinin__InfluenzaA__ALE32059

SEQ ID NO: 105057 - RNA, 1701 nt, Artificial Sequence
  derived and/or modified sequence opt2 from hemagglutinin__InfluenzaA__ALE32060
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccaggucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucauccacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105058 - RNA, 1701 nt, Artificial Sequence
  derived and/or modified sequence opt2 from hemagglutinin__InfluenzaA__ALE32061
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaaguacaccuaccccgcccucaacgucaccaugcccaacaacgagcaguucgacaagcucuacaucuggggcguccaccaccccggcaccgacaacgaccagaucuuccucuacgcccgcuccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105059 - RNA, 1701 nt, Artificial Sequence
  derived and/or modified sequence opt2 from hemagglutinin__InfluenzaA__ALE32062
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucuacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105060 - RNA, 1701 nt, Artificial Sequence; identical to SEQ ID NO: 103953
  derived and/or modified sequence opt2 from hemagglutinin__InfluenzaA__ALE32063

SEQ ID NO: 105061 - RNA, 1701 nt, Artificial Sequence
  derived and/or modified sequence opt2 from hemagglutinin__InfluenzaA__ALE32064
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccaacuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaucggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105062 - RNA, 1701 nt, Artificial Sequence; identical to SEQ ID NO: 103953
  derived and/or modified sequence opt2 from hemagglutinin__InfluenzaA__ALE32065

SEQ ID NO: 105063 - RNA, 1701 nt, Artificial Sequence
  derived and/or modified sequence opt2 from hemagglutinin__InfluenzaA__ALE32066
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucuccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105064 - RNA, 1701 nt, Artificial Sequence; identical to SEQ ID NO: 104735
  derived and/or modified sequence opt2 from hemagglutinin__InfluenzaA__ALE32067

SEQ ID NO: 105065 - RNA, 1701 nt, Artificial Sequence; identical to SEQ ID NO: 103953
  derived and/or modified sequence opt2 from hemagglutinin__InfluenzaA__ALE32068

SEQ ID NO: 105066 - RNA, 1701 nt, Artificial Sequence; identical to SEQ ID NO: 103953
  derived and/or modified sequence opt2 from hemagglutinin__InfluenzaA__ALE32069

SEQ ID NO: 105067 - RNA, 1701 nt, Artificial Sequence
  derived and/or modified sequence opt2 from hemagglutinin__InfluenzaA__ALE32070
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgucugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105068 - RNA, 1701 nt, Artificial Sequence; identical to SEQ ID NO: 103953
  derived and/or modified sequence opt2 from hemagglutinin__InfluenzaA__ALE32071

SEQ ID NO: 105069 - RNA, 1701 nt, Artificial Sequence; identical to SEQ ID NO: 104950
  derived and/or modified sequence opt2 from hemagglutinin__InfluenzaA__ALE32072

SEQ ID NO: 105070 - RNA, 1701 nt, Artificial Sequence
  derived and/or modified sequence opt2 from hemagglutinin__InfluenzaA__ALE32073
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105071 - RNA, 1701 nt, Artificial Sequence
  derived and/or modified sequence opt2 from hemagglutinin__InfluenzaA__ALE32074
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105072 - RNA, 1701 nt, Artificial Sequence
  derived and/or modified sequence opt2 from hemagglutinin__InfluenzaA__ALE32075
augaagaccaucaucgcccucuccuacauccucugccucgucuucgcccagaagcuccccgagaacgacaacuccaccgccacccucugccucggccaccacgccguccccaacggcaccaucgucaagaccaucaccuccgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccuccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105073 - RNA, 1701 nt, Artificial Sequence; identical to SEQ ID NO: 104510
  derived and/or modified sequence opt2 from hemagglutinin__InfluenzaA__ALE32076

SEQ ID NO: 105074 - RNA, 1701 nt, Artificial Sequence
  derived and/or modified sequence opt2 from hemagglutinin__InfluenzaA__ALE32077
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105075 - RNA, 1701 nt, Artificial Sequence; identical to SEQ ID NO: 104611
  derived and/or modified sequence opt2 from hemagglutinin__InfluenzaA__ALE32078

SEQ ID NO: 105076 - RNA, 1701 nt, Artificial Sequence; identical to SEQ ID NO: 104497
  derived and/or modified sequence opt2 from hemagglutinin__InfluenzaA__ALE32079

SEQ ID NO: 105077 - RNA, 1701 nt, Artificial Sequence
  derived and/or modified sequence opt2 from hemagglutinin__InfluenzaA__ALE32080
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105078 - RNA, 1701 nt, Artificial Sequence; identical to SEQ ID NO: 104611
  derived and/or modified sequence opt2 from hemagglutinin__InfluenzaA__ALE32081

SEQ ID NO: 105079 - RNA, 1701 nt, Artificial Sequence; identical to SEQ ID NO: 104611
  derived and/or modified sequence opt2 from hemagglutinin__InfluenzaA__ALE32082

SEQ ID NO: 105080 - RNA, 1701 nt, Artificial Sequence
  derived and/or modified sequence opt2 from hemagglutinin__InfluenzaA__ALE32083
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagggcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105081 - RNA, 1701 nt, Artificial Sequence; identical to SEQ ID NO: 104568
  derived and/or modified sequence opt2 from hemagglutinin__InfluenzaA__ALE32084

SEQ ID NO: 105082 - RNA, 1701 nt, Artificial Sequence; identical to SEQ ID NO: 104611
  derived and/or modified sequence opt2 from hemagglutinin__InfluenzaA__ALE32085

SEQ ID NO: 105083 - RNA, 1701 nt, Artificial Sequence
  derived and/or modified sequence opt2 from hemagglutinin__InfluenzaA__ALE32086
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucuccaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105084 - RNA, 1701 nt, Artificial Sequence
  derived and/or modified sequence opt2 from hemagglutinin__InfluenzaA__ALE32087
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucgacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaaccucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105085 - RNA, 1701 nt, Artificial Sequence
  derived and/or modified sequence opt2 from hemagglutinin__InfluenzaA__ALE32088
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccuccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccgucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105086 - RNA, 1701 nt, Artificial Sequence; identical to SEQ ID NO: 103953
  derived and/or modified sequence opt2 from hemagglutinin__InfluenzaA__ALE32089

SEQ ID NO: 105087 - RNA, 1701 nt, Artificial Sequence; identical to SEQ ID NO: 103953
  derived and/or modified sequence opt2 from hemagglutinin__InfluenzaA__ALE32090

SEQ ID NO: 105088 - RNA, 1701 nt, Artificial Sequence; identical to SEQ ID NO: 103953
  derived and/or modified sequence opt2 from hemagglutinin__InfluenzaA__ALE32091

SEQ ID NO: 105089 - RNA, 1701 nt, Artificial Sequence
  derived and/or modified sequence opt2 from hemagglutinin__InfluenzaA__ALE32092
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugccgcuccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgagcacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105090 - RNA, 1701 nt, Artificial Sequence; identical to SEQ ID NO: 104559
  derived and/or modified sequence opt2 from hemagglutinin__InfluenzaA__ALE32093

SEQ ID NO: 105091 - RNA, 1701 nt, Artificial Sequence
  derived and/or modified sequence opt2 from hemagglutinin__InfluenzaA__ALE32094
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaccuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105092 - RNA, 1701 nt, Artificial Sequence; identical to SEQ ID NO: 103953
  derived and/or modified sequence opt2 from hemagglutinin__InfluenzaA__ALE32095

SEQ ID NO: 105093 - RNA, 1701 nt, Artificial Sequence
  derived and/or modified sequence opt2 from hemagglutinin__InfluenzaA__ALE32096
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucuccuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105094 - RNA, 1701 nt, Artificial Sequence; identical to SEQ ID NO: 103953
  derived and/or modified sequence opt2 from hemagglutinin__InfluenzaA__ALE32097

SEQ ID NO: 105095 - RNA, 1701 nt, Artificial Sequence; identical to SEQ ID NO: 104559
  derived and/or modified sequence opt2 from hemagglutinin__InfluenzaA__ALE32099

SEQ ID NO: 105096 - RNA, 1701 nt, Artificial Sequence
  derived and/or modified sequence opt2 from hemagglutinin__InfluenzaA__ALE32100
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgaccuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105097 - RNA, 1701 nt, Artificial Sequence
  derived and/or modified sequence opt2 from hemagglutinin__InfluenzaA__ALE32101
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacucccagugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccggcuccuucuucucccgccucaacuggcucacccaccucaaguacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105098 - RNA, 1701 nt, Artificial Sequence
  derived and/or modified sequence opt2 from hemagglutinin__InfluenzaA__ALE32102
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaaguacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucuccaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105099 - RNA, 1701 nt, Artificial Sequence; identical to SEQ ID NO: 104666
  derived and/or modified sequence opt2 from hemagglutinin__InfluenzaA__ALE32103

SEQ ID NO: 105100 - RNA, 1701 nt, Artificial Sequence
  derived and/or modified sequence opt2 from hemagglutinin__InfluenzaA__ALE32104
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105101 - RNA, 1701 nt, Artificial Sequence; identical to SEQ ID NO: 104611
  derived and/or modified sequence opt2 from hemagglutinin__InfluenzaA__ALE32105

SEQ ID NO: 105102 - RNA, 1701 nt, Artificial Sequence; identical to SEQ ID NO: 104611
  derived and/or modified sequence opt2 from hemagglutinin__InfluenzaA__ALE32106

SEQ ID NO: 105103 - RNA, 1701 nt, Artificial Sequence; identical to SEQ ID NO: 104666
  derived and/or modified sequence opt2 from hemagglutinin__InfluenzaA__ALE32107

SEQ ID NO: 105104 - RNA, 1701 nt, Artificial Sequence; identical to SEQ ID NO: 104896
  derived and/or modified sequence opt2 from hemagglutinin__InfluenzaA__ALE32108

SEQ ID NO: 105105 - RNA, 1701 nt, Artificial Sequence; identical to SEQ ID NO: 104510
  derived and/or modified sequence opt2 from hemagglutinin__InfluenzaA__ALE32109

SEQ ID NO: 105106 - RNA, 1701 nt, Artificial Sequence; identical to SEQ ID NO: 104497
  derived and/or modified sequence opt2 from hemagglutinin__InfluenzaA__ALE32110

SEQ ID NO: 105107 - RNA, 1701 nt, Artificial Sequence; identical to SEQ ID NO: 103953
  derived and/or modified sequence opt2 from hemagglutinin__InfluenzaA__ALE32111

SEQ ID NO: 105108 - RNA, 1701 nt, Artificial Sequence
  derived and/or modified sequence opt2 from hemagglutinin__InfluenzaA__ALE32112
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacgccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105109 - RNA, 1701 nt, Artificial Sequence
  derived and/or modified sequence opt2 from hemagglutinin__InfluenzaA__ALE32113
augaagaccaucaucgcccucuccuacauccucugccucgucuucgcccagaagauccccggcaacgacaacuccaccgccacccucugccucggccaccacgccguccccaacggcaccgucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagaugcgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105110 - RNA, 1701 nt, Artificial Sequence; identical to SEQ ID NO: 104497
  derived and/or modified sequence opt2 from hemagglutinin__InfluenzaA__ALE32114

SEQ ID NO: 105111 - RNA, 1701 nt, Artificial Sequence; identical to SEQ ID NO: 104497
  derived and/or modified sequence opt2 from hemagglutinin__InfluenzaA__ALE32115

SEQ ID NO: 105112 - RNA, 1701 nt, Artificial Sequence
  derived and/or modified sequence opt2 from hemagglutinin__InfluenzaA__ALE32116
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacguccgcugcaacaucugcaucuga

SEQ ID NO: 105113 - RNA, 1701 nt, Artificial Sequence
  derived and/or modified sequence opt2 from hemagglutinin__InfluenzaA__ALE32117
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgacuucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccgaguacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105114 - RNA, 1701 nt, Artificial Sequence; identical to SEQ ID NO: 104559
  derived and/or modified sequence opt2 from hemagglutinin__InfluenzaA__ALE32118

SEQ ID NO: 105115 - RNA, 1701 nt, Artificial Sequence; identical to SEQ ID NO: 94181
  derived and/or modified sequence opt2 from hemagglutinin__InfluenzaA__ALM06086

SEQ ID NO: 105116 - RNA, 1701 nt, Artificial Sequence; identical to SEQ ID NO: 101552
  derived and/or modified sequence opt2 from hemagglutinin__InfluenzaA__ALM06087

SEQ ID NO: 105117 - RNA, 1701 nt, Artificial Sequence
  derived and/or modified sequence opt2 from hemagglutinin__InfluenzaA__ALM06088
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105118 - RNA, 1701 nt, Artificial Sequence; identical to SEQ ID NO: 101552
  derived and/or modified sequence opt2 from hemagglutinin__InfluenzaA__ALM06089

SEQ ID NO: 105119 - RNA, 1701 nt, Artificial Sequence
  derived and/or modified sequence opt2 from hemagglutinin__InfluenzaA__ALN39661
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 105120 - RNA, 1701 nt, Artificial Sequence; identical to SEQ ID NO: 104486
  derived and/or modified sequence opt2 from hemagglutinin__InfluenzaA__ALN39662

SEQ ID NO: 105121 - RNA, 1701 nt, Artificial Sequence; identical to SEQ ID NO: 103953
  derived and/or modified sequence opt2 from hemagglutinin__InfluenzaA__ALN39663

SEQ ID NO: 105122 - RNA, 1701 nt, Artificial Sequence
  derived and/or modified sequence opt2 from hemagglutinin__InfluenzaA__ALN39664
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccagcccuccggccgcgucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105123 - RNA, 1701 nt, Artificial Sequence; identical to SEQ ID NO: 103953
  derived and/or modified sequence opt2 from hemagglutinin__InfluenzaA__ALN39665

SEQ ID NO: 105124 - RNA, 1701 nt, Artificial Sequence; identical to SEQ ID NO: 104559
  derived and/or modified sequence opt2 from hemagglutinin__InfluenzaA__ALN39666

SEQ ID NO: 105125 - RNA, 1701 nt, Artificial Sequence
  derived and/or modified sequence opt2 from hemagglutinin__InfluenzaA__ALN39667
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucacccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcaacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105126 - RNA, 1701 nt, Artificial Sequence; identical to SEQ ID NO: 105028
  derived and/or modified sequence opt2 from hemagglutinin__InfluenzaA__ALN39668

SEQ ID NO: 105127 - RNA, 1701 nt, Artificial Sequence
  derived and/or modified sequence opt2 from hemagglutinin__InfluenzaA__ALN39669
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccagcucuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105128 - RNA, 1701 nt, Artificial Sequence; identical to SEQ ID NO: 103953
  derived and/or modified sequence opt2 from hemagglutinin__InfluenzaA__ALN39670

SEQ ID NO: 105129 - RNA, 1701 nt, Artificial Sequence
  derived and/or modified sequence opt2 from hemagglutinin__InfluenzaA__ALN39671
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105130 - RNA, 1701 nt, Artificial Sequence; identical to SEQ ID NO: 103953
  derived and/or modified sequence opt2 from hemagglutinin__InfluenzaA__ALN39672

SEQ ID NO: 105131 - RNA, 1701 nt, Artificial Sequence
  derived and/or modified sequence opt2 from hemagglutinin__InfluenzaA__ALN39673
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccgacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105132 - RNA, 1701 nt, Artificial Sequence; identical to SEQ ID NO: 104493
  derived and/or modified sequence opt2 from hemagglutinin__InfluenzaA__ALN39674

SEQ ID NO: 105133 - RNA, 1701 nt, Artificial Sequence; identical to SEQ ID NO: 103953
  derived and/or modified sequence opt2 from hemagglutinin__InfluenzaA__ALN39675

SEQ ID NO: 105134 - RNA, 1701 nt, Artificial Sequence
  derived and/or modified sequence opt2 from hemagglutinin__InfluenzaA__ALN39676
augaagaccaucaucgcccucuccugcauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuuccgcauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaguccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105135 - RNA, 1701 nt, Artificial Sequence
  derived and/or modified sequence opt2 from hemagglutinin__InfluenzaA__ALN39677
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacgccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105136 - RNA, 1701 nt, Artificial Sequence; identical to SEQ ID NO: 104840
  derived and/or modified sequence opt2 from hemagglutinin__InfluenzaA__ALN39678

SEQ ID NO: 105137 - RNA, 1701 nt, Artificial Sequence
  derived and/or modified sequence opt2 from hemagglutinin__InfluenzaA__ALN39679
augaagaccaucaucgcccucggcuacauccucugccucgucuucgcccagaagauccccggcaacgacaacuccaccgccacccucugccucggccaccacgccguccccaacggcaccgucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105138 - RNA, 1701 nt, Artificial Sequence; identical to SEQ ID NO: 104840
  derived and/or modified sequence opt2 from hemagglutinin__InfluenzaA__ALN39680

SEQ ID NO: 105139 - RNA, 1701 nt, Artificial Sequence; identical to SEQ ID NO: 104840
  derived and/or modified sequence opt2 from hemagglutinin__InfluenzaA__ALN39681

SEQ ID NO: 105140 - RNA, 1701 nt, Artificial Sequence; identical to SEQ ID NO: 104840
  derived and/or modified sequence opt2 from hemagglutinin__InfluenzaA__ALN39682

SEQ ID NO: 105141 - RNA, 1701 nt, Artificial Sequence; identical to SEQ ID NO: 104840
  derived and/or modified sequence opt2 from hemagglutinin__InfluenzaA__ALN39683

SEQ ID NO: 105142 - RNA, 1701 nt, Artificial Sequence; identical to SEQ ID NO: 104840
  derived and/or modified sequence opt2 from hemagglutinin__InfluenzaA__ALN39684

SEQ ID NO: 105143 - RNA, 1701 nt, Artificial Sequence; identical to SEQ ID NO: 104840
  derived and/or modified sequence opt2 from hemagglutinin__InfluenzaA__ALN39685

SEQ ID NO: 105144 - RNA, 1701 nt, Artificial Sequence
  derived and/or modified sequence opt2 from hemagglutinin__InfluenzaA__ALN39686
augaagaccaucaucgcccucggcuacauccucugccucgccuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacaccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105145 - RNA, 1701 nt, Artificial Sequence; identical to SEQ ID NO: 104840
  derived and/or modified sequence opt2 from hemagglutinin__InfluenzaA__ALN39687

SEQ ID NO: 105146 - RNA, 1701 nt, Artificial Sequence
  derived and/or modified sequence opt2 from hemagglutinin__InfluenzaA__ALN39688
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaucuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105147 - RNA, 1701 nt, Artificial Sequence
  derived and/or modified sequence opt2 from hemagglutinin__InfluenzaA__ALN39689
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucauccacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105148 - RNA, 1701 nt, Artificial Sequence
  derived and/or modified sequence opt2 from hemagglutinin__InfluenzaA__ALN39690
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaucuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105149 - RNA, 1701 nt, Artificial Sequence
  derived and/or modified sequence opt2 from hemagglutinin__InfluenzaA__ALN39691
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105150 - RNA, 1701 nt, Artificial Sequence; identical to SEQ ID NO: 104840
  derived and/or modified sequence opt2 from hemagglutinin__InfluenzaA__ALN39692

SEQ ID NO: 105151 - RNA, 1701 nt, Artificial Sequence; identical to SEQ ID NO: 104840
  derived and/or modified sequence opt2 from hemagglutinin__InfluenzaA__ALN39693

SEQ ID NO: 105152 - RNA, 1701 nt, Artificial Sequence; identical to SEQ ID NO: 104840
  derived and/or modified sequence opt2 from hemagglutinin__InfluenzaA__ALN39694

SEQ ID NO: 105153 - RNA, 1701 nt, Artificial Sequence; identical to SEQ ID NO: 104840
  derived and/or modified sequence opt2 from hemagglutinin__InfluenzaA__ALN39695

SEQ ID NO: 105154 - RNA, 1701 nt, Artificial Sequence; identical to SEQ ID NO: 104840
  derived and/or modified sequence opt2 from hemagglutinin__InfluenzaA__ALN39696

SEQ ID NO: 105155 - RNA, 1701 nt, Artificial Sequence; identical to SEQ ID NO: 104510
  derived and/or modified sequence opt2 from hemagglutinin__InfluenzaA__ALN39697

SEQ ID NO: 105156 - RNA, 1701 nt, Artificial Sequence
  derived and/or modified sequence opt2 from hemagglutinin__InfluenzaA__ALN39698
augaagaccaucaucgcccucucccacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaugggcuccauccgcaacggcaccuacgaccacaacgucuaccgcaacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105157 - RNA, 1701 nt, Artificial Sequence
  derived and/or modified sequence opt2 from hemagglutinin__InfluenzaA__ALN39700
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 105158 - RNA, 1701 nt, Artificial Sequence; identical to SEQ ID NO: 104559
  derived and/or modified sequence opt2 from hemagglutinin__InfluenzaA__ALN39701

SEQ ID NO: 105159 - RNA, 1701 nt, Artificial Sequence
  derived and/or modified sequence opt2 from hemagglutinin__InfluenzaA__ALN39702
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcuccaucugcaucuga

SEQ ID NO: 105160 - RNA, 1701 nt, Artificial Sequence
  derived and/or modified sequence opt2 from hemagglutinin__InfluenzaA__ALN39703
augaagaccaucaucgcccucuccuacauccucugccucgucuucgcccagaagauccccggcaacgacgacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105161 - RNA, 1701 nt, Artificial Sequence; identical to SEQ ID NO: 104559
  derived and/or modified sequence opt2 from hemagglutinin__InfluenzaA__ALN39704

SEQ ID NO: 105162 - RNA, 1701 nt, Artificial Sequence; identical to SEQ ID NO: 103953
  derived and/or modified sequence opt2 from hemagglutinin__InfluenzaA__ALN39705

SEQ ID NO: 105163 - RNA, 1701 nt, Artificial Sequence
  derived and/or modified sequence opt2 from hemagglutinin__InfluenzaA__ALN39706
augaagaccaucaucgcccucuccuacauccucugccucgucuucgcccagaagcuccccggcaacgacaacuccaccgccacccucugccucggccaccacgccguccccaacggcaugaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacgacuuccagaacaagcgcugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105164 - RNA, 1701 nt, Artificial Sequence; identical to SEQ ID NO: 103953
  derived and/or modified sequence opt2 from hemagglutinin__InfluenzaA__ALN39707

SEQ ID NO: 105165 - RNA, 1701 nt, Artificial Sequence; identical to SEQ ID NO: 104559
  derived and/or modified sequence opt2 from hemagglutinin__InfluenzaA__ALN39708

SEQ ID NO: 105166 - RNA, 1701 nt, Artificial Sequence
  derived and/or modified sequence opt2 from hemagglutinin__InfluenzaA__ALN39709
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcaugcgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucacccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105167 - RNA, 1701 nt, Artificial Sequence; identical to SEQ ID NO: 104883
  derived and/or modified sequence opt2 from hemagglutinin__InfluenzaA__ALN39710

SEQ ID NO: 105168 - RNA, 1701 nt, Artificial Sequence; identical to SEQ ID NO: 104559
  derived and/or modified sequence opt2 from hemagglutinin__InfluenzaA__ALN39711

SEQ ID NO: 105169 - RNA, 1701 nt, Artificial Sequence; identical to SEQ ID NO: 103953
  derived and/or modified sequence opt2 from hemagglutinin__InfluenzaA__ALN39712

SEQ ID NO: 105170 - RNA, 1701 nt, Artificial Sequence
  derived and/or modified sequence opt2 from hemagglutinin__InfluenzaA__ALN39713
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105171 - RNA, 1701 nt, Artificial Sequence
  derived and/or modified sequence opt2 from hemagglutinin__InfluenzaA__ALN39714
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaccuuccucuacgcccagcccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105172 - RNA, 1701 nt, Artificial Sequence; identical to SEQ ID NO: 104611
  derived and/or modified sequence opt2 from hemagglutinin__InfluenzaA__ALN39715

SEQ ID NO: 105173 - RNA, 1701 nt, Artificial Sequence; identical to SEQ ID NO: 103953
  derived and/or modified sequence opt2 from hemagglutinin__InfluenzaA__ALN39716

SEQ ID NO: 105174 - RNA, 1701 nt, Artificial Sequence; identical to SEQ ID NO: 103953
  derived and/or modified sequence opt2 from hemagglutinin__InfluenzaA__ALN39717

SEQ ID NO: 105175 - RNA, 1701 nt, Artificial Sequence; identical to SEQ ID NO: 104991
  derived and/or modified sequence opt2 from hemagglutinin__InfluenzaA__ALN39718

SEQ ID NO: 105176 - RNA, 1701 nt, Artificial Sequence; identical to SEQ ID NO: 103953
  derived and/or modified sequence opt2 from hemagglutinin__InfluenzaA__ALN39734

SEQ ID NO: 105177 - RNA, 1701 nt, Artificial Sequence
  derived and/or modified sequence opt2 from hemagglutinin__InfluenzaA__ALN39735
augaagaccaucaucgcccucuccuacauccucugccucgucuucgcccagaagauccccggcaacgacaacuccaccgccacccucugccucggccaccacgccguccccaacggcaccaucgucaagaccaucaccgacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105178 - RNA, 1701 nt, Artificial Sequence
  derived and/or modified sequence opt2 from hemagglutinin__InfluenzaA__ALN39736
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcggcggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccagaaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105179 - RNA, 1701 nt, Artificial Sequence; identical to SEQ ID NO: 104559
  derived and/or modified sequence opt2 from hemagglutinin__InfluenzaA__ALN39737

SEQ ID NO: 105180 - RNA, 1701 nt, Artificial Sequence
  derived and/or modified sequence opt2 from hemagglutinin__InfluenzaA__ALN39738
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccucugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105181 - RNA, 1701 nt, Artificial Sequence
  derived and/or modified sequence opt2 from hemagglutinin__InfluenzaA__ALN39739
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccacaagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucgacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105182 - RNA, 1701 nt, Artificial Sequence
  derived and/or modified sequence opt2 from hemagglutinin__InfluenzaA__ALN39740
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccguccccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcuaccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105183 - RNA, 1701 nt, Artificial Sequence; identical to SEQ ID NO: 103953
  derived and/or modified sequence opt2 from hemagglutinin__InfluenzaA__ALN39741

SEQ ID NO: 105184 - RNA, 1701 nt, Artificial Sequence
  derived and/or modified sequence opt2 from hemagglutinin__InfluenzaA__ALN39742
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgacugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105185 - RNA, 1701 nt, Artificial Sequence
  derived and/or modified sequence opt2 from hemagglutinin__InfluenzaA__ALN39743
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaucuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105186 - RNA, 1701 nt, Artificial Sequence
  derived and/or modified sequence opt2 from hemagglutinin__InfluenzaA__ALN39744
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105187 - RNA, 1701 nt, Artificial Sequence
  derived and/or modified sequence opt2 from hemagglutinin__InfluenzaA__ALN39745
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105188 - RNA, 1701 nt, Artificial Sequence; identical to SEQ ID NO: 105186
  derived and/or modified sequence opt2 from hemagglutinin__InfluenzaA__ALN39746

SEQ ID NO: 105189 - RNA, 1701 nt, Artificial Sequence; identical to SEQ ID NO: 104881
  derived and/or modified sequence opt2 from hemagglutinin__InfluenzaA__ALN39747

SEQ ID NO: 105190 - RNA, 1701 nt, Artificial Sequence
  derived and/or modified sequence opt2 from hemagglutinin__InfluenzaA__ALN39748
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacgccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105191 - RNA, 1701 nt, Artificial Sequence
  derived and/or modified sequence opt2 from hemagglutinin__InfluenzaA__ALN39749
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105192 - RNA, 1701 nt, Artificial Sequence; identical to SEQ ID NO: 103953
  derived and/or modified sequence opt2 from hemagglutinin__InfluenzaA__ALN39750

SEQ ID NO: 105193 - RNA, 1701 nt, Artificial Sequence; identical to SEQ ID NO: 103953
  derived and/or modified sequence opt2 from hemagglutinin__InfluenzaA__ALN39789

SEQ ID NO: 105194 - RNA, 1701 nt, Artificial Sequence; identical to SEQ ID NO: 104483
  derived and/or modified sequence opt2 from hemagglutinin__InfluenzaA__ALO75895

SEQ ID NO: 105195 - RNA, 1701 nt, Artificial Sequence
  derived and/or modified sequence opt2 from hemagglutinin__InfluenzaA__ALO75907
auggagaagaucguccuccuccucgccaucgucucccucgucaagggcgaccagaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcugguuccucggcaaccgcaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagacccucaucauccccaaguccuccuggcccaaccacaccuccuccggcgucuccgccgccugccccuaccagggcaugcccuccuucuuccgcaacgucgucuggcucaccaagaagaacgacgccuaccccaccaucaagauguccuacaacaacaccuaccgcgaggaccuccucauccucuggggcauccaccacuccaacaacgccgccgagcagaccaaccucuacaagaaccccaccaccuacgucuccgucggcaccuccacccucaaccagcgccucgagcccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgaccgcgaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccucuacuccgaggaggcccgccucaagcgcgaggagaucuccggcgucaagcucgaguccaucggcaccuaccagauccucuccaacuacuccaccgucgccuccucccucgcccucgccaucaucgucgccggccucucccucuggaugugcuccaacggcucccuccagugccgcaucugcaucuga

SEQ ID NO: 105196 - RNA, 1701 nt, Artificial Sequence
  derived and/or modified sequence opt2 from hemagglutinin__InfluenzaA__ALO75919
auggagaagaucguccuccuccucgccaucgucucccucgucaagggcgaccagaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccacggcaaccgcaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagacccucaucauccccaaguccuccuggcccaaccacaccuccuccggcgucuccgccgccugccccuaccagggcaugcccuccuucuuccgcaacgucgucuggcucaccaagaagaacgacgccuaccccaccaucaagauguccuacaacaacaccuaccgcgaggaccuccucauccucuggggcauccaccacuccaacaacgccgccgagcagaccaaccucuacaagaaccccaccaccuacgucuccgucggcaccuccacccucaaccagcgccucgagcccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgaccgcgaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccucuacuccgaggaggccucccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 105197 - RNA, 1683 nt, Artificial Sequence
  derived and/or modified sequence opt2 from hemagglutinin__InfluenzaA__ALT20080
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccucucccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacgacggcaccuccaccgccugcuccggcuccuucuaccgcuccaugcgcuggcucacccgcaagaacggcgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguucggccacauccucuccggcgagucccacggccgcauccucaagaccaaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 105198 - RNA, 1701 nt, Artificial Sequence
  derived and/or modified sequence opt2 from hemagglutinin__InfluenzaA__ALT66860
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105199 - RNA, 1701 nt, Artificial Sequence
  derived and/or modified sequence opt2 from hemagglutinin__InfluenzaA__AMA65391
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcggccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucuuccucggcgccaucuccuucuggaugugcuccaacggcucccuccagugccgcaucugcaucuga

SEQ ID NO: 105200 - RNA, 1701 nt, Artificial Sequence
  derived and/or modified sequence opt2 from hemagglutinin__InfluenzaA__AMA65393
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacucccccgucgccuccucccucguccucgucgucuuccucggcgccaucuccuucuggaugugcuccaacggcucccuccagugccgcaucugcaucuga

SEQ ID NO: 105201 - RNA, 1701 nt, Artificial Sequence
  derived and/or modified sequence opt2 from hemagglutinin__InfluenzaA__BAA02768
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaaggaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuaccgcaaccuccucuggcucaccggcaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggaguaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcuacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 105202 - RNA, 1701 nt, Artificial Sequence
  derived and/or modified sequence opt2 from hemagglutinin__InfluenzaA__BAA02769
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaaggaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuaccgcaaccuccucuggcucaccggcaagaacggccucuaccccaaccucuccaaguccuacgucaacaacaaggagaaggagguccucguccucuggggcguccaccaccccuccaacauccgcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaagggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggaguaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcuacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 105203 - RNA, 1689 nt, Artificial Sequence
  derived and/or modified sequence opt2 from hemagglutinin__InfluenzaA__BAC43764
auggccaucaucuaccucauccuccucuucaccgccguccgcggcgaccagaucugcaucggcuaccacgccaacaacuccaccgagaaggucgacaccauccucgagcgcaacgucaccgucacccacgccaagaacauccucgagaagacccacaacggcaagcucugcaagcucaacggcauccccccccucgagcucggcgacugcuccaucgccggcuggcuccucggcaaccccgagugcgaccgccuccucaucguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccgucgccaagggcuccuacaacaacaccuccggcgagcagaugcucaucaucuggggcguccaccaccccaucgacgagaccgagcagaucacccucuaccagaacgucggcaccuacgucuccgucggcaccuccacccucaacaagcgcuccacccccgagaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccaguuccgcaucugcaucuga

SEQ ID NO: 105204 - RNA, 1707 nt, Artificial Sequence
  derived and/or modified sequence opt2 from hemagglutinin__InfluenzaA__BAE07201
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcgacuucaacgacuacgaggagcucaagcaccuccucucccgcaucaaccacuucgagaagauccagaucauccccaagaacuccugguccucccacgaggccucccucggcgucuccuccgccugccccuaccagggcaaguccuccuucuuccgcaacgucgucuggcucaucaagaagaacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccagaacggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105205 - RNA, 1701 nt, Artificial Sequence
  derived and/or modified sequence opt2 from hemagglutinin__InfluenzaA__BAH95823
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaagcacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105206 - RNA, 1701 nt, Artificial Sequence; identical to SEQ ID NO: 94168
  derived and/or modified sequence opt2 from hemagglutinin__InfluenzaA__BAH95824

SEQ ID NO: 105207 - RNA, 1707 nt, Artificial Sequence
  derived and/or modified sequence opt2 from hemagglutinin__InfluenzaA__BAJ07997
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcgacuucaacgacuacgaggagcucaagcaccuccucucccgcaucaaccacuucgagaagauccagaucauccccaagaacuccugguccucccacgaggccucccucggcgucuccuccgccugccccuaccagggcaaguccuccuucuuccgcaacgucgucuggcucaucaagaagaacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105208 - RNA, 1701 nt, Artificial Sequence
  derived and/or modified sequence opt2 from hemagglutinin__InfluenzaA__BAJ39949
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccaagcuccucguccuccucaagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105209 - RNA, 1701 nt, Artificial Sequence
  derived and/or modified sequence opt2 from hemagglutinin__InfluenzaA__BAJ39950
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgccgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105210 - RNA, 1701 nt, Artificial Sequence
  derived and/or modified sequence opt2 from hemagglutinin__InfluenzaA__BAJ39951
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccuuccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105211 - RNA, 1701 nt, Artificial Sequence; identical to SEQ ID NO: 100784
  derived and/or modified sequence opt2 from hemagglutinin__InfluenzaA__BAJ39952

SEQ ID NO: 105212 - RNA, 1701 nt, Artificial Sequence
  derived and/or modified sequence opt2 from hemagglutinin__InfluenzaA__BAJ39953
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccaagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105213 - RNA, 1701 nt, Artificial Sequence; identical to SEQ ID NO: 100784
  derived and/or modified sequence opt2 from hemagglutinin__InfluenzaA__BAJ39954

SEQ ID NO: 105214 - RNA, 1701 nt, Artificial Sequence
  derived and/or modified sequence opt2 from hemagglutinin__InfluenzaA__BAJ39955
augaaggccauccucgucguccuccucuacaccuucgccaccgccaacgccgacacccucuccaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaucuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugcaagaucugcaucuga

SEQ ID NO: 105215 - RNA, 1701 nt, Artificial Sequence; identical to SEQ ID NO: 105209
  derived and/or modified sequence opt2 from hemagglutinin__InfluenzaA__BAJ39956

SEQ ID NO: 105216 - RNA, 1701 nt, Artificial Sequence; identical to SEQ ID NO: 100784
  derived and/or modified sequence opt2 from hemagglutinin__InfluenzaA__BAJ39957

SEQ ID NO: 105217 - RNA, 1701 nt, Artificial Sequence
  derived and/or modified sequence opt2 from hemagglutinin__InfluenzaA__BAJ39958
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105218 - RNA, 1701 nt, Artificial Sequence
  derived and/or modified sequence opt2 from hemagglutinin__InfluenzaA__BAJ39959
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuucauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105219 - RNA, 1701 nt, Artificial Sequence; identical to SEQ ID NO: 94181
  derived and/or modified sequence opt2 from hemagglutinin__InfluenzaA__BAJ39960

SEQ ID NO: 105220 - RNA, 1701 nt, Artificial Sequence; identical to SEQ ID NO: 94810
  derived and/or modified sequence opt2 from hemagglutinin__InfluenzaA__BAJ39961

SEQ ID NO: 105221 - RNA, 1701 nt, Artificial Sequence
  derived and/or modified sequence opt2 from hemagglutinin__InfluenzaA__BAJ39962
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgccgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaccuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuucauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105222 - RNA, 1701 nt, Artificial Sequence; identical to SEQ ID NO: 94181
  derived and/or modified sequence opt2 from hemagglutinin__InfluenzaA__BAJ39963

SEQ ID NO: 105223 - RNA, 1701 nt, Artificial Sequence; identical to SEQ ID NO: 100784
  derived and/or modified sequence opt2 from hemagglutinin__InfluenzaA__BAJ39964

SEQ ID NO: 105224 - RNA, 1701 nt, Artificial Sequence; identical to SEQ ID NO: 94181
  derived and/or modified sequence opt2 from hemagglutinin__InfluenzaA__BAJ39965

SEQ ID NO: 105225 - RNA, 1701 nt, Artificial Sequence; identical to SEQ ID NO: 94181
  derived and/or modified sequence opt2 from hemagglutinin__InfluenzaA__BAJ39966

SEQ ID NO: 105226 - RNA, 1701 nt, Artificial Sequence
  derived and/or modified sequence opt2 from hemagglutinin__InfluenzaA__BAJ39967
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgcccucggcaaggaguucaaccaccucgagaagaagaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105227 - RNA, 1701 nt, Artificial Sequence; identical to SEQ ID NO: 99709
  derived and/or modified sequence opt2 from hemagglutinin__InfluenzaA__BAJ39968

SEQ ID NO: 105228 - RNA, 1701 nt, Artificial Sequence; identical to SEQ ID NO: 100784
  derived and/or modified sequence opt2 from hemagglutinin__InfluenzaA__BAJ39969

SEQ ID NO: 105229 - RNA, 1701 nt, Artificial Sequence; identical to SEQ ID NO: 94181
  derived and/or modified sequence opt2 from hemagglutinin__InfluenzaA__BAJ39970

SEQ ID NO: 105230 - RNA, 1701 nt, Artificial Sequence; identical to SEQ ID NO: 94181
  derived and/or modified sequence opt2 from hemagglutinin__InfluenzaA__BAJ39971

SEQ ID NO: 105231 - RNA, 1701 nt, Artificial Sequence; identical to SEQ ID NO: 94810
  derived and/or modified sequence opt2 from hemagglutinin__InfluenzaA__BAJ39972

SEQ ID NO: 105232 - RNA, 1701 nt, Artificial Sequence
  derived and/or modified sequence opt2 from hemagglutinin__InfluenzaA__BAJ39973
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105233 - RNA, 1701 nt, Artificial Sequence; identical to SEQ ID NO: 94181
  derived and/or modified sequence opt2 from hemagglutinin__InfluenzaA__BAJ39974

SEQ ID NO: 105234 - RNA, 1701 nt, Artificial Sequence; identical to SEQ ID NO: 94750
  derived and/or modified sequence opt2 from hemagglutinin__InfluenzaA__BAJ39975

SEQ ID NO: 105235 - RNA, 1701 nt, Artificial Sequence
  derived and/or modified sequence opt2 from hemagglutinin__InfluenzaA__BAJ39976
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacgagaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucaacuucuggaugugcuccaacggcucccuccagugccgcaucugcaucuga

SEQ ID NO: 105236 - RNA, 1701 nt, Artificial Sequence; identical to SEQ ID NO: 94181
  derived and/or modified sequence opt2 from hemagglutinin__InfluenzaA__BAJ39977

SEQ ID NO: 105237 - RNA, 1701 nt, Artificial Sequence
  derived and/or modified sequence opt2 from hemagglutinin__InfluenzaA__BAJ39978
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgagcaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccacuccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105238 - RNA, 1701 nt, Artificial Sequence
  derived and/or modified sequence opt2 from hemagglutinin__InfluenzaA__BAJ39979
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcauggacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaaccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105239 - RNA, 1701 nt, Artificial Sequence; identical to SEQ ID NO: 100784
  derived and/or modified sequence opt2 from hemagglutinin__InfluenzaA__BAJ39980

SEQ ID NO: 105240 - RNA, 1701 nt, Artificial Sequence
  derived and/or modified sequence opt2 from hemagglutinin__InfluenzaA__BAJ39981
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugcuccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105241 - RNA, 1701 nt, Artificial Sequence
  derived and/or modified sequence opt2 from hemagglutinin__InfluenzaA__BAJ39982
augaaggccauccucgucguccuccucuacaccuucgccaccgccaacgccgccacccucugcaucggcuaccacgccaacaacuccaccgacaccgucgacacccuccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105242 - RNA, 1701 nt, Artificial Sequence; identical to SEQ ID NO: 105209
  derived and/or modified sequence opt2 from hemagglutinin__InfluenzaA__BAJ39983

SEQ ID NO: 105243 - RNA, 1701 nt, Artificial Sequence
  derived and/or modified sequence opt2 from hemagglutinin__InfluenzaA__BAJ39984
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105244 - RNA, 1701 nt, Artificial Sequence; identical to SEQ ID NO: 94181
  derived and/or modified sequence opt2 from hemagglutinin__InfluenzaA__BAJ39985

SEQ ID NO: 105245 - RNA, 1701 nt, Artificial Sequence
  derived and/or modified sequence opt2 from hemagglutinin__InfluenzaA__BAJ39987
augaagaccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105246 - RNA, 1701 nt, Artificial Sequence
  derived and/or modified sequence opt2 from hemagglutinin__InfluenzaA__BAJ39988
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccaucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugcuccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105247 - RNA, 1701 nt, Artificial Sequence; identical to SEQ ID NO: 95495
  derived and/or modified sequence opt2 from hemagglutinin__InfluenzaA__BAJ39989

SEQ ID NO: 105248 - RNA, 1701 nt, Artificial Sequence; identical to SEQ ID NO: 94181
  derived and/or modified sequence opt2 from hemagglutinin__InfluenzaA__BAJ39990

SEQ ID NO: 105249 - RNA, 1701 nt, Artificial Sequence; identical to SEQ ID NO: 94181
  derived and/or modified sequence opt2 from hemagglutinin__InfluenzaA__BAJ39993

SEQ ID NO: 105250 - RNA, 1701 nt, Artificial Sequence
  derived and/or modified sequence opt2 from hemagglutinin__InfluenzaA__BAJ39994
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaccaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugccucgaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105251 - RNA, 1701 nt, Artificial Sequence; identical to SEQ ID NO: 94181
  derived and/or modified sequence opt2 from hemagglutinin__InfluenzaA__BAJ39996

SEQ ID NO: 105252 - RNA, 1701 nt, Artificial Sequence
  derived and/or modified sequence opt2 from hemagglutinin__InfluenzaA__BAJ39997
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaccaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105253 - RNA, 1701 nt, Artificial Sequence; identical to SEQ ID NO: 94181
  derived and/or modified sequence opt2 from hemagglutinin__InfluenzaA__BAJ39998

SEQ ID NO: 105254 - RNA, 1701 nt, Artificial Sequence
  derived and/or modified sequence opt2 from hemagglutinin__InfluenzaA__BAJ39999
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105255 - RNA, 1701 nt, Artificial Sequence
  derived and/or modified sequence opt2 from hemagglutinin__InfluenzaA__BAJ40000
augaagaccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105256 - RNA, 1701 nt, Artificial Sequence; identical to SEQ ID NO: 99191
  derived and/or modified sequence opt2 from hemagglutinin__InfluenzaA__BAJ40001

SEQ ID NO: 105257 - RNA, 1701 nt, Artificial Sequence; identical to SEQ ID NO: 94181
  derived and/or modified sequence opt2 from hemagglutinin__InfluenzaA__BAJ40002

SEQ ID NO: 105258 - RNA, 1701 nt, Artificial Sequence; identical to SEQ ID NO: 99191
  derived and/or modified sequence opt2 from hemagglutinin__InfluenzaA__BAJ40003

SEQ ID NO: 105259 - RNA, 1701 nt, Artificial Sequence
  derived and/or modified sequence opt2 from hemagglutinin__InfluenzaA__BAJ40004
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgagaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105260 - RNA, 1701 nt, Artificial Sequence
  derived and/or modified sequence opt2 from hemagglutinin__InfluenzaA__BAJ40006
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggccgcgagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105261 - RNA, 1701 nt, Artificial Sequence; identical to SEQ ID NO: 94181
  derived and/or modified sequence opt2 from hemagglutinin__InfluenzaA__BAJ40007

SEQ ID NO: 105262 - RNA, 1701 nt, Artificial Sequence
  derived and/or modified sequence opt2 from hemagglutinin__InfluenzaA__BAJ40008
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaucgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105263 - RNA, 1701 nt, Artificial Sequence
  derived and/or modified sequence opt2 from hemagglutinin__InfluenzaA__BAJ40009
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcauggacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaaccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105264 - RNA, 1701 nt, Artificial Sequence
  derived and/or modified sequence opt2 from hemagglutinin__InfluenzaA__BAJ40010
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcauggacuacuacuggacccucgucgagcccggcgacaagaucaccuucgaggccaccggcaaccucgucgucccccgcuacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105265 - RNA, 1701 nt, Artificial Sequence; identical to SEQ ID NO: 105254
  derived and/or modified sequence opt2 from hemagglutinin__InfluenzaA__BAJ40011

SEQ ID NO: 105266 - RNA, 1701 nt, Artificial Sequence
  derived and/or modified sequence opt2 from hemagglutinin__InfluenzaA__BAJ40012
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcaucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105267 - RNA, 1701 nt, Artificial Sequence; identical to SEQ ID NO: 105254
  derived and/or modified sequence opt2 from hemagglutinin__InfluenzaA__BAJ40013

SEQ ID NO: 105268 - RNA, 1701 nt, Artificial Sequence; identical to SEQ ID NO: 105254
  derived and/or modified sequence opt2 from hemagglutinin__InfluenzaA__BAJ40014

SEQ ID NO: 105269 - RNA, 1701 nt, Artificial Sequence
  derived and/or modified sequence opt2 from hemagglutinin__InfluenzaA__BAJ40015
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaacaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105270 - RNA, 1701 nt, Artificial Sequence; identical to SEQ ID NO: 105254
  derived and/or modified sequence opt2 from hemagglutinin__InfluenzaA__BAJ40016

SEQ ID NO: 105271 - RNA, 1701 nt, Artificial Sequence
  derived and/or modified sequence opt2 from hemagglutinin__InfluenzaA__BAJ40017
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaaggccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105272 - RNA, 1701 nt, Artificial Sequence; identical to SEQ ID NO: 95345
  derived and/or modified sequence opt2 from hemagglutinin__InfluenzaA__BAJ40018

SEQ ID NO: 105273 - RNA, 1701 nt, Artificial Sequence; identical to SEQ ID NO: 105260
  derived and/or modified sequence opt2 from hemagglutinin__InfluenzaA__BAJ40019

SEQ ID NO: 105274 - RNA, 1701 nt, Artificial Sequence; identical to SEQ ID NO: 105260
  derived and/or modified sequence opt2 from hemagglutinin__InfluenzaA__BAJ40020

SEQ ID NO: 105275 - RNA, 1701 nt, Artificial Sequence
  derived and/or modified sequence opt2 from hemagglutinin__InfluenzaA__BAJ40021
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgagaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105276 - RNA, 1701 nt, Artificial Sequence; identical to SEQ ID NO: 95345
  derived and/or modified sequence opt2 from hemagglutinin__InfluenzaA__BAJ40023

SEQ ID NO: 105277 - RNA, 1701 nt, Artificial Sequence
  derived and/or modified sequence opt2 from hemagglutinin__InfluenzaA__BAJ40024
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105278 - RNA, 1701 nt, Artificial Sequence; identical to SEQ ID NO: 105254
  derived and/or modified sequence opt2 from hemagglutinin__InfluenzaA__BAJ40025

SEQ ID NO: 105279 - RNA, 1701 nt, Artificial Sequence; identical to SEQ ID NO: 95345
  derived and/or modified sequence opt2 from hemagglutinin__InfluenzaA__BAJ40026

SEQ ID NO: 105280 - RNA, 1701 nt, Artificial Sequence
  derived and/or modified sequence opt2 from hemagglutinin__InfluenzaA__BAJ40027
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgagaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105281 - RNA, 1701 nt, Artificial Sequence
  derived and/or modified sequence opt2 from hemagglutinin__InfluenzaA__BAJ40028
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccgccuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105282 - RNA, 1701 nt, Artificial Sequence; identical to SEQ ID NO: 105254
  derived and/or modified sequence opt2 from hemagglutinin__InfluenzaA__BAJ40029

SEQ ID NO: 105283 - RNA, 1701 nt, Artificial Sequence
  derived and/or modified sequence opt2 from hemagglutinin__InfluenzaA__BAJ40030
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcucaaggagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggccgcgagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105284 - RNA, 1701 nt, Artificial Sequence; identical to SEQ ID NO: 94181
  derived and/or modified sequence opt2 from hemagglutinin__InfluenzaA__BAJ40031

SEQ ID NO: 105285 - RNA, 1701 nt, Artificial Sequence; identical to SEQ ID NO: 105254
  derived and/or modified sequence opt2 from hemagglutinin__InfluenzaA__BAJ40032

SEQ ID NO: 105286 - RNA, 1701 nt, Artificial Sequence; identical to SEQ ID NO: 105283
  derived and/or modified sequence opt2 from hemagglutinin__InfluenzaA__BAJ40033

SEQ ID NO: 105287 - RNA, 1701 nt, Artificial Sequence
  derived and/or modified sequence opt2 from hemagglutinin__InfluenzaA__BAJ40034
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105288 - RNA, 1701 nt, Artificial Sequence
  derived and/or modified sequence opt2 from hemagglutinin__InfluenzaA__BAJ40035
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaaguucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105289 - RNA, 1701 nt, Artificial Sequence
  derived and/or modified sequence opt2 from hemagglutinin__InfluenzaA__BAJ40036
augaaggccauccucgucguccucaucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggaccaucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105290 - RNA, 1701 nt, Artificial Sequence; identical to SEQ ID NO: 100784
  derived and/or modified sequence opt2 from hemagglutinin__InfluenzaA__BAJ40037

SEQ ID NO: 105291 - RNA, 1701 nt, Artificial Sequence
  derived and/or modified sequence opt2 from hemagglutinin__InfluenzaA__BAJ40038
augaaggccauccuccucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggaccaucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105292 - RNA, 1701 nt, Artificial Sequence; identical to SEQ ID NO: 94181
  derived and/or modified sequence opt2 from hemagglutinin__InfluenzaA__BAJ40039

SEQ ID NO: 105293 - RNA, 1701 nt, Artificial Sequence
  derived and/or modified sequence opt2 from hemagglutinin__InfluenzaA__BAJ40040
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggccgcgagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuacggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105294 - RNA, 1701 nt, Artificial Sequence; identical to SEQ ID NO: 100784
  derived and/or modified sequence opt2 from hemagglutinin__InfluenzaA__BAJ40041

SEQ ID NO: 105295 - RNA, 1701 nt, Artificial Sequence
  derived and/or modified sequence opt2 from hemagglutinin__InfluenzaA__BAJ40042
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcucaaggagccccucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggccgcgagguccucguccucuggggcauccaccaccccuccaccuccgccgaccgccagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105296 - RNA, 1701 nt, Artificial Sequence; identical to SEQ ID NO: 100784
  derived and/or modified sequence opt2 from hemagglutinin__InfluenzaA__BAJ40043

SEQ ID NO: 105297 - RNA, 1701 nt, Artificial Sequence
  derived and/or modified sequence opt2 from hemagglutinin__InfluenzaA__BAJ40044
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcagaaggagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaucaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105298 - RNA, 1701 nt, Artificial Sequence; identical to SEQ ID NO: 105260
  derived and/or modified sequence opt2 from hemagglutinin__InfluenzaA__BAJ40045

SEQ ID NO: 105299 - RNA, 1701 nt, Artificial Sequence
  derived and/or modified sequence opt2 from hemagglutinin__InfluenzaA__BAJ40046
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggccgcugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcucaaggagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagaagaucgagaaccucaacaagaaggucgacgacggcuuccucgacaucuggaccuacaacgccaagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105300 - RNA, 1701 nt, Artificial Sequence; identical to SEQ ID NO: 105283
  derived and/or modified sequence opt2 from hemagglutinin__InfluenzaA__BAJ40047

SEQ ID NO: 105301 - RNA, 1701 nt, Artificial Sequence; identical to SEQ ID NO: 105254
  derived and/or modified sequence opt2 from hemagglutinin__InfluenzaA__BAJ40048

SEQ ID NO: 105302 - RNA, 1701 nt, Artificial Sequence
  derived and/or modified sequence opt2 from hemagglutinin__InfluenzaA__BAJ40050
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcucaaggagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105303 - RNA, 1701 nt, Artificial Sequence; identical to SEQ ID NO: 95345
  derived and/or modified sequence opt2 from hemagglutinin__InfluenzaA__BAJ40051

SEQ ID NO: 105304 - RNA, 1701 nt, Artificial Sequence
  derived and/or modified sequence opt2 from hemagglutinin__InfluenzaA__BAJ40052
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggccgcgagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105305 - RNA, 1701 nt, Artificial Sequence
  derived and/or modified sequence opt2 from hemagglutinin__InfluenzaA__BAJ40053
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105306 - RNA, 1701 nt, Artificial Sequence; identical to SEQ ID NO: 95345
  derived and/or modified sequence opt2 from hemagglutinin__InfluenzaA__BAJ40054

SEQ ID NO: 105307 - RNA, 1701 nt, Artificial Sequence
  derived and/or modified sequence opt2 from hemagglutinin__InfluenzaA__BAJ40055
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaucugccagacccccaagggcgccaucaacaccucccuccccuuccagaacauccaccccaucaccaucggcaagugccccaaguacgucaaguccaccaagcuccgccucgccaccggccuccgcaacguccccuccguccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105308 - RNA, 1701 nt, Artificial Sequence
  derived and/or modified sequence opt2 from hemagglutinin__InfluenzaA__BAJ40056
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcaggucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgccacgccuucgccauggagcgcaacgccggcuccggcaucaucaucuccgacacccccguccacaacugcaacaccaccugccagacccccaagggcgccaucaacaccucccuccccuuccagaacauccaccccaucaccaucggcaagugccccaaguacgucaagucccccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccuacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105309 - RNA, 1701 nt, Artificial Sequence
  derived and/or modified sequence opt2 from hemagglutinin__InfluenzaA__BAJ40057
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacgaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105310 - RNA, 1701 nt, Artificial Sequence; identical to SEQ ID NO: 100784
  derived and/or modified sequence opt2 from hemagglutinin__InfluenzaA__BAJ40058

SEQ ID NO: 105311 - RNA, 1701 nt, Artificial Sequence; identical to SEQ ID NO: 105254
  derived and/or modified sequence opt2 from hemagglutinin__InfluenzaA__BAJ40059

SEQ ID NO: 105312 - RNA, 1701 nt, Artificial Sequence; identical to SEQ ID NO: 95345
  derived and/or modified sequence opt2 from hemagglutinin__InfluenzaA__BAJ40060

SEQ ID NO: 105313 - RNA, 1701 nt, Artificial Sequence
  derived and/or modified sequence opt2 from hemagglutinin__InfluenzaA__BAJ40061
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105314 - RNA, 1701 nt, Artificial Sequence
  derived and/or modified sequence opt2 from hemagglutinin__InfluenzaA__BAJ40062
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagaagaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugcaagaucugcaucuga

SEQ ID NO: 105315 - RNA, 1701 nt, Artificial Sequence; identical to SEQ ID NO: 105313
  derived and/or modified sequence opt2 from hemagglutinin__InfluenzaA__BAJ40063

SEQ ID NO: 105316 - RNA, 1701 nt, Artificial Sequence; identical to SEQ ID NO: 100784
  derived and/or modified sequence opt2 from hemagglutinin__InfluenzaA__BAJ40064

SEQ ID NO: 105317 - RNA, 1707 nt, Artificial Sequence
  derived and/or modified sequence opt2 from hemagglutinin__InfluenzaA__BAK23398
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgucaacgaccucugcuaccccggcaacuucaacgacuacgaggagcucaagcaccuccucucccgcaucaaccacuucgagaagauccagaucuuccccaaguccuccugguccgaccacgaggccuccuccggcgucuccuccgccugccccuaccagggccgcuccuccuucuuccgcaacgucgucuggcucgucaagaaggacaacgccuaccccaccaucaagaaguccuacaacaacaccaaccaggaggaccuccucauccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcaucgaguucuucuggaccauccucaaguccaacgacgucaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccgcggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccgucaagaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaugauggccggccucuuccucuggaugugcuccaacggcucccuccagugccgcaucugcaucuga

SEQ ID NO: 105318 - RNA, 1707 nt, Artificial Sequence
  derived and/or modified sequence opt2 from hemagglutinin__InfluenzaA__BAK23400
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcgacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccacaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccucccgccucguccucgccaccggccuccgcaacuccccccagggcaagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucuuccucuggaugugcuccaacggcucccuccagugccgcaucugcaucuga

SEQ ID NO: 105319 - RNA, 1707 nt, Artificial Sequence
  derived and/or modified sequence opt2 from hemagglutinin__InfluenzaA__BAK23401
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacgucuccgagugguccuacaucgucgagaagaucaaccccgccaacgaccucugcuaccccggcaacuucaacaacuacgaggagcucaagcaccuccucucccgcaucaaccgcuucgagaagauccagaucauccccaaguccuccuggcccgaccacgaggccucccucggcgucuccuccgccugccccuaccagggcggccccuccuucuaccgcaacgucgucuggcucaucaagaagaacaacaccuaccccaucaucaagaaguccuaccacaacaccaaccaggaggaccuccucguccucuggggcauccaccaccccaacgacgaggaggagcagacccgcaucuacaagaaccccaccaccuacaucuccgucggcaccuccacccucaaccagcgccucguccccaagaucgccacccgcuccaaggucaacggccaguccggccgcgucgaguucuucuggaccauccucaaguccaacgacaccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacauccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105320 - RNA, 1707 nt, Artificial Sequence
  derived and/or modified sequence opt2 from hemagglutinin__InfluenzaA__BAK23402
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccaaccacgaggccuccuccggcgucuccuccgccugccccuaccagggccgcuccuccuucuuccgcaacgucgucuggcucaucaagaaggacaacgccuaccccaccaucaagaucuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacacccacccccucaccaucggcgagugccccaaguacgucaaguccaaccgccucguccucgccaccggccuccgcaacuccccccacggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105321 - RNA, 1707 nt, Artificial Sequence
  derived and/or modified sequence opt2 from hemagglutinin__InfluenzaA__BAK23403
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccaaccacgaggccuccuccggcgucuccuccgccugccccuaccagggccgcuccuccuucuuccgcaacgucgucuggcucaucaagaaggacaacgccuaccccaccaucaagaucuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105322 - RNA, 1707 nt, Artificial Sequence
  derived and/or modified sequence opt2 from hemagglutinin__InfluenzaA__BAK23404
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105323 - RNA, 1707 nt, Artificial Sequence; identical to SEQ ID NO: 105322
  derived and/or modified sequence opt2 from hemagglutinin__InfluenzaA__BAK23405

SEQ ID NO: 105324 - RNA, 1707 nt, Artificial Sequence
  derived and/or modified sequence opt2 from hemagglutinin__InfluenzaA__BAK23406
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgucaacgaccucugcuaccccggcaacuucaacgacuacgaggagcucaagcaccuccucucccgcaucaaccacuucgagaagauccagaucuuccccaaguccuccugguccgaccacgaggccuccuccggcgucuccuccgccugccccuaccagggccgcuccuccuucuuccgcaacgucgucuggcucgucaagaaggacaacgccuaccccaccaucaagaaguccuacaacaacaccaaccaggaggaccuccucauccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcaucgaguucuucuggaccauccucaaguccaacgacgucaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccgucaagaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaugauggccggccucuuccucuggaugugcuccaacggcucccuccagugccgcaucugcaucuga

SEQ ID NO: 105325 - RNA, 1707 nt, Artificial Sequence
  derived and/or modified sequence opt2 from hemagglutinin__InfluenzaA__BAK23407
auggagaagaucguccuccuccucgccaucgucucccucgucaaguccggccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacgucuccgagugguccuacaucgucgagaagaucaaccccgccaacgaccucugcuaccccggcaacuucaacaacuacgaggagcucaagcaccuccucucccgcaucaaccgcuucgagaagauccagaucauccccaaguccuccuggcccgaccacgaggccucccucggcgucuccgccgccugccccuaccagggcggccccuccuucuaccgcaacgucgucuggcucaucaagaagaacaacaccuaccccaccaucgagaaguccuaccacaacaccaaccaggaggaccuccucguccucuggggcauccaccaccccaacgacgaggccgagcagacccgcaucuacaagaaccccaccaccuacaucuccgucggcaccuccacccucaaccagcgccucguccccaagaucgccacccgcuccaaggucaacggccaguccggccgcgucgaguucuucuggaccauccucaaguccaacgacaccaucaacuucgaguccaacggcaacuucaucgcccccgagaacgccuacaagaucgucaagaagggcgacuccaccaucaugaaguccgagcucgaguacggcaacugcaacacccgcugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105326 - RNA, 1707 nt, Artificial Sequence
  derived and/or modified sequence opt2 from hemagglutinin__InfluenzaA__BAK23408
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccccaacgucuccgagugguccuacaucgucgagaagaucaaccccgccaacgaccucugcuaccccggcaacuucaacaacuacgaggagcucaagcaccuccucucccgcaucaaccgcuucgagaagauccagaucauccccaaguccuccuggcccgaccacgaggccucccucggcgucuccuccgccugccaguaccagggcggccccuccuucuaccgcaacgucgucuggcucaucaagaaggacaacgccuaccccaccaucaagaaguccuaccacaacaccaacaaggaggaccuccucguccucuggggcauccaccaccccaacaacgaggaggagcagaccaagcucuaccagaaccccaccaccuacaucuccgucggcaccuccacccucaaccagcgccucguccccaagaucgccacccgcuccaaggucaacggccaguccggccgcgucgaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacuacaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggcaaggaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105327 - RNA, 1707 nt, Artificial Sequence
  derived and/or modified sequence opt2 from hemagglutinin__InfluenzaA__BAK23411
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacgucuccgagugguccuacaucgucgagaagaucaaccccgccaacgaccucugcuaccccggcaacuucaacaacuacgaggagcucaagcaccuccucucccgcaucaaccgcuucgagaagauccagaucauccccaaguccuccuggcccgaccacgaggccucccucggcgucuccuccgccugccaguaccagggcggccccuccuucuaccgcaacgucgucuggcucaucaagaaggacaacgccuaccccaccaucaagaaguccuaccacaacaccaacaaggaggaccuccucguccucuggggcauccaccaccccaacaacgaggaggagcagaccaagcucuaccagaaccccaccaccuacaucuccgucggcaccuccacccucaaccagcgccucguccccaagaucgccacccgcuccaaggucaacggccaguccggccgcgucgaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggcaaggaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105328 - RNA, 1707 nt, Artificial Sequence
  derived and/or modified sequence opt2 from hemagglutinin__InfluenzaA__BAK23412
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaagggcaagcucugcgaccucgacggcgucaagccccucauccuccgcgacugcuccgucgccggcuggcuccucggcaaccccaugugcgacgaguuccucaacgucuccgagugguccuacaucgucgagaagaucaaccccgccaacgaccucugcuaccccggcaacuucaacaacuacgaggagcucaagcaccuccucucccgcaucaaccgcuucgagaagauccagaucauccccaaguccuccuggcccgaccacgaggccucccucggcgucuccuccgccugccaguaccagggcggccccuccuucuaccgcaacgucgucuggcucaucaagaaggacaacaccuaccccaccaucaagaaguccuaccacaacaccaacaaggaggaccuccucguccucuggggcauccaccaccccaacaacgaggaggagcagaccaagcucuaccagaaccccaccaccuacaucuccgucggcaccuccacccucaaccagcgccucguccccaagaucgccacccgcuccaaggucaacggccaguccggccgcgucgaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggcaaggaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaccggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105329 - RNA, 1707 nt, Artificial Sequence
  derived and/or modified sequence opt2 from hemagglutinin__InfluenzaA__BAK23413
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacgucuccgagugguccuacaucgucgagaagaucaaccccgccaacgaccucugcuaccccggcaacuucaacaacuacgaggagcucaagcaccuccucucccgcaucaaccgcuucgagaagauccagaucauccccaaguccuccuggcccgaccacgaggccucccucggcgucuccuccgccugccaguaccagggcggccccuccuucuaccgcaacgucgucuggcucaucaagaaggacaacaccuaccccaccaucaagaaguccuaccacaacaccaacaaggaggaccuccucguccucuggggcauccaccaccccaacaacgaggaggagcagaccaagcucuaccagaaccccaccaccuacaucuccgucggcaccuccacccucaaccagcgccucguccccaagaucgccacccgcuccaaggucaacggccaguccggccgcgucgaguucuucuggaccauccucaaguccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggcaaggaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105330 - RNA, 1707 nt, Artificial Sequence; identical to SEQ ID NO: 105327
  derived and/or modified sequence opt2 from hemagglutinin__InfluenzaA__BAK23414

SEQ ID NO: 105331 - RNA, 1698 nt, Artificial Sequence
  derived and/or modified sequence opt2 from hemagglutinin__InfluenzaA__BAM65746
auggaggucaagcuccucguccuccucugcaccuucaccgccaccuacgccgacaccaucugcaucggcuaccacgccaacaacuccaccgacaccgucgacacccuccccgagaagaacgucaccgucacccacuccgucaaccuccucgaggacacccacaacggcaagcucugccuccucaagggcaucgccccccuccagcucggcaacugcuccgucgccggcuggauccucggcaaccccgagugcgagcuccucaucucccgcgaguccugguccuacaucgucgagaagcccaaccccgagaacggcaucugcuaccccggccacuucgccgacuacgaggagcuccgcgagcagcucuccuccgucuccuccuucgagcgcuucgagaucuuccccaaggaguccuccuggcccaaccacaccgccaccggcgucuccgccuccugcucccacaacggcaaguccuccuucuacaagaaccuccucuggcucaccgucaagaacggccucuaccccaaccucuccaaguccuacgccaacaacaaggagaaggagguccucguccucuggggcguccaccaccccaccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaaguccaacgcccccauggacgagugcaacgccaagugccagaccccccagggcgccaucaacuccucccuccccuuccagaacguccaccccgucaccaucggcgagugccccaaguacguccgcuccaccaagcuccgcauggucaccggccuccgcaacacccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucgacaaggaguucaacaagcucgagcgccgcauggagaacuucaacaagaaggucgacgacggcuucaucgacaucuggaccuacaacgccgagcuccucauccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccuccaugguccuccucgucucccucggcgccaucuccuucuggaugugcuccaacggcucccuccagugccgcaucugcaucuga

SEQ ID NO: 105332 - RNA, 1701 nt, Artificial Sequence; identical to SEQ ID NO: 104078
  derived and/or modified sequence opt2 from hemagglutinin__InfluenzaA__BAO79716

SEQ ID NO: 105333 - RNA, 1683 nt, Artificial Sequence
  derived and/or modified sequence opt2 from Hemagglutinin__InfluenzaA__CAB95856
auggagaccaucucccucaucaccauccuccucgucgucaccgccuccaacgccgacaagaucugcaucggccaccaguccaccaacuccaccgagaccgucgacacccucaccgagaccaacguccccgucacccacgccaaggagcuccuccacaccgagcacaacggcaugcucugcgccaccucccucggccacccccucauccucgacaccugcaccaucgagggccucgucuacggcaaccccuccugcgaccuccuccucggcggccgcgagugguccuacaucgucgagcgcuccuccgccgucaacggcaccugcuaccccggcaacgucgagaaccucgaggagcuccgcacccucuucuccuccgccuccuccuaccagcgcauccagaucuuccccgacaccaccuggaacgucaccuacaccggcaccucccgcgccugcuccggcuccuucuaccgcuccaugcgcuggcucacccagaaguccggcuucuaccccguccaggacgcccaguacaccaacaaccgcggcaaguccauccucuucgucuggggcauccaccacccccccaccuacaccgagcagaccaaccucuacauccgcaacgacaccaccaccuccgucaccaccgaggaccucaaccgcaccuucaagcccgucaucggcccccgcccccucgucaacggccuccagggccgcaucgacuacuacugguccguccucaagcccggccagacccuccgcguccgcuccaacggcaaccucaucgcccccugguacggccacguccucuccggcggcucccacggccgcauccucaagaccgaccucaagggcggcaacugcgucguccagugccagaccgagaagggcggccucaacuccacccuccccuuccacaacaucuccaaguacgccuucggcaccugccccaaguacguccgcgucaacucccucaagcucgccgucggccuccgcaacguccccgcccgcuccucccgcggccucuucggcgccaucgccggcuucaucgagggcggcuggcccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacgucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguaccgcgaggagucccgccucgagcgccagaagaucgagggcgucaagcucgaguccgagggcaccuacaagauccucaccaucuacuccaccgucgccuccucccucguccucgccaugggcuucgccgccuuccucuucugggccauguccaacggcuccugccgcugcaacaucugcaucuga

SEQ ID NO: 105334 - RNA, 1683 nt, Artificial Sequence
  derived and/or modified sequence opt2 from Hemagglutinin__InfluenzaA__CAB95857
auggagaccaucucccucaucaccauccuccucgucgucaccgccuccaacgccgacaagaucugcaucggccaccaguccaccaacuccaccgagaccgucgacacccucaccgagaccaacguccccgucacccacgccaaggagcuccuccacaccgagcacaacggcaugcucugcgccaccucccucggccacccccucauccucgacaccugcaccaucgagggccucgucuacggcaaccccuccugcgaccuccuccucgagggccgcgagugguccuacaucgucgagcgcuccuccgccgucaacggcaccugcuaccccggcaacgucgagaaccucgaggagcuccgcacccucuucuccuccgccuccuccuaccagcgcauccagaucuuccccgacaccaccuggaacgucaccuacaccggcaccucccgcgccugcuccggcuccuucuaccgcuccaugcgcuggcucacccagaaguccggcuucuaccccguccaggacgcccaguacaccaacaaccgcggcaaguccauccucuucgucuggggcauccaccacccccccaccuacaccgagcagaccaaccucuacauccgcaacgacaccaccaccuccgucaccaccgaggaccucaaccgcaccuucaagcccgucaucggcccccgcccccucgucaacggccuccagggccgcaucgacuacuacugguccguccucaagcccggccagacccuccgcguccgcuccaacggcaaccucaucgcccccugguacggccacguccucuccggcggcucccacggccgcauccucaagaccgaccucaaguccggcaacugcgucguccagugccagaccgagaagggcggccucaacuccacccuccccuuccacaacaucuccaaguacgccuucggcaccugccccaaguacguccgcgucaacucccucaagcucgccgucggccuccgcaacguccccgcccgcuccucccgcggccucuucggcgccaucgccggcuucaucgagggcggcuggcccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacgucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguaccgcgaggagucccgccucgagcgccagaagaucgagggcgucaagcucgaguccgagggcgccuacaagauccucaccaucuacuccaccgucgccuccucccucguccucgccaugggcuucgccgccuuccucuucugggccauguccaacggcuccugccgcugcaacaucugcaucuga

SEQ ID NO: 105335 - RNA, 1707 nt, Artificial Sequence
  derived and/or modified sequence opt2 from hemagglutinin__InfluenzaA__CBW54815
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccccaacgucuccgagugguccuacaucgucgagaagaccaaccccgccaacgaccucugcuaccccggcaacuucgacaacuacgaggagcucaagcaccuccucucccgcaucaaccgcuucgagaagauccagaucauccccaaguccuccuggcccgaccacgaggccucccucggcgucuccuccgccugccccuaccagggcggccccuccuucuaccgcaacgucgucuggcucaucaagaagaacaacaccuaccccaccaucaaggaguccuaccacaacaccaaccaggaggaccuccucguccucuggggcauccaccaccccaacgacgaggaggagcagacccgcaucuacaagaaccccaccaccuacaucuccgucggcaccuccacccucaaccagcgccucguccccaagaucgccacccgcuccaaggucaacggccaguccggccgcgucgaguucuucuggaccauccucaaguccaacgacaccaucaacuucgaguccaacggcaacuucaucgcccccgagaacgccuacaagaucgucaagaagggcgacuccaccaucaugaaguccgagcucgaguacggcaacugcuccaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagggccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagaagcgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105336 - RNA, 1707 nt, Artificial Sequence
  derived and/or modified sequence opt2 from hemagglutinin__InfluenzaA__CBW54817
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccccaacgucuccgagugguccuacaucgucgagaagaucaaccccgccaacgaccucugcuaccccggcaacuucaacaacuacgaggagcucaagcaccuccucucccgcaucaaccgcuucgagaagauccagaucauccccaaguccuccuggcccgaccacgaggccucccucggcgucuccuccgccugccccuaccagcgcggccccuccuucuaccgcaacgucgucuggcucaucaagaagaacgacaccuaccccaccaucaaggaguccuaccacaacaccaaccaggaggaccuccucguccucuggggcauccaccaccccaacgacgaggaggagcagaagcgcaucuacaagaaccccaccaccuacaucuccgucggcaccuccacccucaaccagcgccucguccccaagaucgccacccgcuccaaggucaacggccaguccggccgcgucgaguucuucuggaccauccucaaguccaacgacaccaucaacuucgaguccaacggcaacuucaucgcccccgagaacgccuacaagaucgucaagaagggcgacuccaccaucaugaaguccgagcucgaguacggcaacugcuccaccaagugccagacccccaucggcgccaucaacaccuccaugcccuuccacaacauccacccccucaccaucggcgagugccccaaguacgucaaguccaaccgccucguccucgccaccggccuccgcaacuccccccagggcgagggccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagaagcgcaucgagaaccucaacaagaagauggaggacggcuuccucgacgucuggaccuacaacgccgagcuccucguccucauggagaacgagcgcacccucgacuuccacgacuccaacguccgcaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucuuccucuggaugugcuccaacggcucccuccagugccgcaucugcaucuga

SEQ ID NO: 105337 - RNA, 1707 nt, Artificial Sequence
  derived and/or modified sequence opt2 from hemagglutinin__InfluenzaA__CBW54818
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccccaacgucuccgagugguccuacaucgucgagaagaccaaccccgccaacgaccucugcuaccccggcaacuucaacaacuacgaggagcucaagcaccuccucucccgcaucaaccgcuucgagaagaucaagaucauccccaaguccuccuggcccgaccacgaggccucccucggcgucuccuccgccugccccuaccagggcggccccuccuucuaccgcaacgucgucuggcucaucaagaagaacaacaccuaccccaccaucaaggaguccuaccacaacaccaaccaggaggaccuccucguccucuggggcauccaccaccccaacgacgaggaggagcagacccgcaucuacaagaaccccaccaccuacaucuccgucggcaccuccacccucaaccagcgccucguccccaagaucgccacccgcuccaaggucaacggccaguccggccgcgucgaguucuucuggaccauccucaaguccaacgacaccaucaacuucgaguccaacggcaacuucaucgcccccgagaacgccuacaagaucgucaagaagggcgacuccaccaucaugaaguccgagcucgaguacggcaacugcuccaccaagugccagacccccgucggcgccaucaacuccuccaugcccuuccacaacauccacccccucaccaucggcgagugccccaaguacgucaaguccaaccgccucguccucgccaccggccuccgcaacuccccccagggcgagggccgccgcaagaagcgcggccucuucggcgccaucgccggcuucaucgagggcggcuggcagggcauggucgacggcugguacggcuaccaccacuccaacgagcagggcuccggcuacgccgccgaccgcgaguccacccagaaggccaucgacggcgucaccaacaaggucaacuccaucaucgacaagaugaacacccaguucgaggccgucggccgcgaguucaacaaccucgagaagcgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaucgucgccggccuccuccucuggaugugcuccaacggcucccuccagugccgcaucugcaucuga

SEQ ID NO: 105338 - RNA, 1701 nt, Artificial Sequence
  derived and/or modified sequence opt2 from hemagglutinin__InfluenzaA__CCG47908
augaagaccgucaucgcccucuccuacgucuucugccucggcuucggccagggccuccccggcaagggcaacaacaccgccacccucugccucggccaccacgccguccccaacggcacccucgucaagaccaucaccgacgaccagaucgaggucaccaacgccaccgagcucguccagaacuucuccaugggcaagaucugcaagaacccccaccgcauccucgacggcgccaacugcacccucaucgacucccuccucggcgacccccacugcgacggcuuccaggacgagaagugggaccucuucaucgagcgcuccaaggccuucuccaacugcuaccccuacgacguccccgaguacaccucccuccgcuccaucaucgccuccuccggcacccucgaguucaccaacgaggacuucaacuggaccggcgucacccagaacggcggcuccuccgccugcaagcgcggccccaacaacuccuucuucucccgccucaacuggcucuacaaguccggcaacaccuaccccaugcucaacgucaccaugcccaacuccgacgacuucgacaagcucuacaucuggggcguccaccaccccuccaccgaccgcgagcagaccaaccucuacauccaggccuccggcaagaucaucgucuccaccaagcgcucccagcagaccaucauccccaacaucggcucccgccccuggguccgcggccucuccucccgcaucuccaucuacuggaccaucgucaagcccggcgacauccucaucaucaacuccaacggcaaccucaucgccccccgcggcuacuucaagauccagaccggcaaguccuccgucaugcgcuccgacgcccccaucgacaccugcaacuccgagugcaucacccccaacggcuccauccccaacgacaagcccuuccagaacgucaaccgcaucaccuacggcgccugccccaaguacaucaagcagaacacccucaagcucgccaccggcaugcgcaacauccccgagcgccagacccgcggcaucuucggcgccaucgccggcuucaucgagaacggcugggagggcauggucaacggcugguacggcuuccgccaccagaacuccgagggcaucggccaggccgccgaccucaaguccacccaggccgccaucaaccagaucaacggcaagcucaaccgcgucaucgagaagaccaacgagaaguuccaccagaucgagaaggaguucuccgaggucgagggccgcauccaggaccucgagcgcuacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacuccugcauggaguccauccgcaacggcaccuacgaccacaacgaguaccgcgacgaggccgucaacaaccgcuuccagaucaaguccgucgagcucaaguccggcuacaaggacuggauccucuggaucuccuucgccaucuccugcuuccuccucugcgccgucuggcucggcuucaucaucugggccugccagaagggcaacauccgcugcaacaucugcaucuga

SEQ ID NO: 105339 - RNA, 1701 nt, Artificial Sequence
  derived and/or modified sequence opt2 from hemagglutinin_precursor_(high_yield_phenotype)__InfluenzaA_ _AAB39851
augaaggccauccuccucguccuccucugcaccuucgccgccaccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucggcggcaucgccccccuccaccucggcaagugcaacaucgccggccgccuccucggcaaccccgagugcgagcuccuccucaccgucuccuccugguccuacaucgucgagaccuccaaguccgacaacggcaccugcuaccccggcgacuucaucaacuacgaggagcuccgcgagcagcucuccuccgucuccuccuucgagcgcuucgagaucuuccccaagaccuccuccuggcccaaccacgagaccaaccgcggcgucaccgccgccugccccuacgccggcgccaacuccuucuaccgcaaccucaucuggcucgucaagaaggagaacuccuaccccaagcucuccaaguccuacgucaacaacaagggcaaggagguccucguccucuggggcauccaccacccccccaccuccaccgaccagcagucccucuaccagaacgccgacgccuacgucuucgucggcuccuccaaguacaaccgcaaguucaagcccgagaucgccgcccgccccaagguccgcggccaggccggccgcauguccuacuacuggacccucaucgagcccggcgacaccaucaccuucgaggccaccggcaaccucgucgucccccgcuacgccuucgccaugaaccgcggcuccggcuccggcaucaucaucugggacgcccccguccacgacugcaacaccaagugccagacccccaagggcgccaucaacaccucccuccccuuccagaacauccaccccgucaccaucggcgagugccccaaguacgucaaguccaccaagcuccgcauggccaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagcgcuccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuuccacgacuccaacgucaagaaccucuacgagaagguccgcucccagcuccgcaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 105340 - RNA, 1701 nt, Artificial Sequence
  derived and/or modified sequence opt2 from hemagglutinin_precursor__InfluenzaA__AAA43178
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcauccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggagaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 105341 - RNA, 1689 nt, Artificial Sequence
  derived and/or modified sequence opt2 from hemagglutinin_precursor__InfluenzaA__AAA43185
auggccaucaucuaccucauccuccucuucaccgccguccgcggcgaccagaucugcaucggcuaccacgccaacaacuccaccgagaaggucgacaccaaccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaaggagggcuccgacuaccccgucgccaagggcuccuacaacaacaccuccggcgagcagaugcucaucaucuggggcguccaccaccccaucgacgagaccgagcagcgcacccucuaccagaacgucggcaccuacgucuccgucggcaccuccacccucaacaagcgcuccacccccgagaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucggcaaccucgagcgccgccucgagaaccucaacaagcgcauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 105342 - RNA, 1701 nt, Artificial Sequence
  derived and/or modified sequence opt2 from hemagglutinin_precursor__InfluenzaA__AAA43187
augaagaccaucaucgcccucucccacaucuucugccucguccucggccaguaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccgaguccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacgccaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccacccgcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuacgacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 105343 - RNA, 1698 nt, Artificial Sequence
  derived and/or modified sequence opt2 from hemagglutinin_precursor__InfluenzaA__AAA43209
augaaggccaagcuccucguccuccucuacgccuucgucgccaccgacgccgacaccaucugcaucggcuaccacgccaacaacuccaccgacaccgucgacaccaucuucgagaagaacgucgccgucacccacuccgucaaccuccucgaggaccgccacaacggcaagcucugcaagcucaagggcaucgccccccuccagcucggcaagugcaacaucaccggcuggcuccucggcaaccccgagugcgacucccuccuccccgcccgcuccugguccuacaucgucgagacccccaacuccgagaacggcgccugcuaccccggcgacuucaucgacuacgaggagcuccgcgagcagcucuccuccgucuccucccucgagcgcuucgagaucuuccccaaggaguccuccuggcccaaccacaccuucaacggcgucaccgucuccugcucccaccgcggcaaguccuccuucuaccgcaaccuccucuggcucaccaagaagggcgacuccuaccccaagcucaccaacuccuacgucaacaacaagggcaaggagguccucguccucuggggcguccaccaccccuccuccuccgacgagcagcagucccucuacuccaacggcaacgccuacgucuccgucgccuccuccaacuacaaccgccgcuucacccccgagaucgccgcccgccccaaggucaaggaccagcacggccgcaugaacuacuacuggacccuccucgagcccggcgacaccaucaucuucgaggccaccggcaaccucaucgcccccugguacgccuucgcccucucccgcggcuucgaguccggcaucaucaccuccaacgccuccaugcacgagugcaacaccaagugccagaccccccagggcuccaucaacuccaaccuccccuuccagaacauccaccccgucaccaucggcgagugccccaaguacguccgcuccaccaagcuccgcauggucaccggccuccgcaacauccccuccauccaguaccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgaccucaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 105344 - RNA, 1683 nt, Artificial Sequence
  derived and/or modified sequence opt2 from hemagglutinin_precursor__InfluenzaA__AAC40998
augaacacccagauccucauccucgcccucgucgccaucauccccaccaacgccgacaagaucugccucggccaccacgccgucuccaacggcgccaaggucaacacccucaccgagcgcggcgucgaggucgucaacgccaccgagaccgucgagcgcaccaacgucccccgcaucugcuccaagggcaagcgcaccgucgaccucggccagugcggccuccucggcaccaucaccggccccccccagugcgaccaguuccucgaguucuccgccgaccucaucaucgagcgccgcgagggcaacgacgucugcuaccccggcaaguucgucaacgaggaggcccuccgccagauccuccgcaaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacauccgcaaggaccccgcccucaucaucuggggcauccaccacuccggcuccaccgccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccgagguccaggucgacgccaacugcgagggcgacugcuaccacuccggcggcaccauccucuccucccuccccuuccagaacaucaacucccgcaccgucggcgagugcccccgcuacgucaagcaggagucccuccuccucgccaccggcaugaagaacguccccgagauccccaagggccgcggccucuucggcgccaucgccggcuucaucgagaacggcugggagggccucgucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacucccucaccgagaugugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccauccagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 105345 - RNA, 1683 nt, Artificial Sequence
  derived and/or modified sequence opt2 from hemagglutinin_precursor__InfluenzaA__AAC40999
augaacacccagauccucauccucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccaacgucccccgcaucugcuccaagggcaagcgcaccgucgaccucggccagugcggccuccucggcaccaucaccggccccccccagugcgaccaguuccucgaguucuccgccgaccucaucaucgagcgccgcgagggcgacgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacauccgcaaggaccccgcccucaucaucuggggcauccaccacuccggcuccaccgccgagcagaccaagcucuacggcuccggcaacaagcucaucaccgucggcuccuccaacuaccagcaguccuucguccccauccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccgagguccaggucgacgccaacugcgagggcgacugcuaccacuccggcggcaccauccucaacaaccuccccuuccagaacaucaacggccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucgucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccauccagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 105346 - RNA, 1698 nt, Artificial Sequence; identical to SEQ ID NO: 94000
  derived and/or modified sequence opt2 from hemagglutinin__InfluenzaA__ACA28844

SEQ ID NO: 105347 - RNA, 1698 nt, Artificial Sequence; identical to SEQ ID NO: 99305
  derived and/or modified sequence opt2 from hemagglutinin__InfluenzaA__ACA28844/m1

SEQ ID NO: 105348 - RNA, 1701 nt, Artificial Sequence; identical to SEQ ID NO: 100662
  derived and/or modified sequence opt2 from hemagglutinin__InfluenzaA__ACV82259

SEQ ID NO: 105349 - RNA, 1701 nt, Artificial Sequence; identical to SEQ ID NO: 100662
  derived and/or modified sequence opt2 from hemagglutinin__InfluenzaA__ACV82259/m1

SEQ ID NO: 105350 - RNA, 1701 nt, Artificial Sequence; identical to SEQ ID NO: 100662
  derived and/or modified sequence opt2 from hemagglutinin__InfluenzaA__ACV82259/m2

SEQ ID NO: 105351 - RNA, 1701 nt, Artificial Sequence; identical to SEQ ID NO: 94179
  derived and/or modified sequence opt2 from hemagglutinin__InfluenzaA__ACP41953

SEQ ID NO: 105352 - RNA, 1701 nt, Artificial Sequence; identical to SEQ ID NO: 103753
  derived and/or modified sequence opt2 from hemagglutinin__InfluenzaA__AFM72832

SEQ ID NO: 105353 - RNA, 1701 nt, Artificial Sequence
  derived and/or modified sequence opt2 from hemagglutinin__InfluenzaA__EPI516528
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccacugccgcaucugcgucuga

SEQ ID NO: 105354 - RNA, 1701 nt, Artificial Sequence
  derived and/or modified sequence opt2 from hemagglutinin__InfluenzaA__AGM53850
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105355 - RNA, 1701 nt, Artificial Sequence
  derived and/or modified sequence opt2 from hemagglutinin__InfluenzaA__EPI731463
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaacaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105356 - RNA, 1701 nt, Artificial Sequence; identical to SEQ ID NO: 96010
  derived and/or modified sequence opt2 from hemagglutinin__InfluenzaA__EPI696972

SEQ ID NO: 105357 - RNA, 1701 nt, Artificial Sequence; identical to SEQ ID NO: 105198
  derived and/or modified sequence opt2 from hemagglutinin__InfluenzaA__EPI662594

SEQ ID NO: 105358 - RNA, 1701 nt, Artificial Sequence
  derived and/or modified sequence opt2 from hemagglutinin__InfluenzaA__EPI685579
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccgcgagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105359 - RNA, 1701 nt, Artificial Sequence
  derived and/or modified sequence opt2 from hemagglutinin__InfluenzaA__EPI830230
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcagucccucuaccagaacgccgacgccuacgucuucgucggcaccucccgcuacuccaagauguucaagcccgagaucgccacccgccccaagguccgcgaccgcgagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105360 - RNA, 1701 nt, Artificial Sequence; identical to SEQ ID NO: 94168
  derived and/or modified sequence opt2 from hemagglutinin__InfluenzaA__ACQ45338

SEQ ID NO: 105361 - RNA, 1701 nt, Artificial Sequence; identical to SEQ ID NO: 94168
  derived and/or modified sequence opt2 from hemagglutinin__InfluenzaA__ACQ45338/m1

SEQ ID NO: 105362 - RNA, 1701 nt, Artificial Sequence; identical to SEQ ID NO: 94168
  derived and/or modified sequence opt2 from hemagglutinin__InfluenzaA__ACQ45338/m2

SEQ ID NO: 105363 - RNA, 1701 nt, Artificial Sequence; identical to SEQ ID NO: 93830
  derived and/or modified sequence opt2 from hemagglutinin__InfluenzaA__ACU79871

SEQ ID NO: 105364 - RNA, 1701 nt, Artificial Sequence
  derived and/or modified sequence opt2 from hemagglutinin__InfluenzaA__ACU79871/m1
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucgagucccgccccuggguccgcggccaguccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaaggucaaccgcaucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcuccggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 105365 - RNA, 1701 nt, Artificial Sequence
  derived and/or modified sequence opt2 from hemagglutinin__InfluenzaA__EPI643118
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaucgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagcuccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105366 - RNA, 1701 nt, Artificial Sequence; identical to SEQ ID NO: 103953
  derived and/or modified sequence opt2 from hemagglutinin__InfluenzaA__EPI675798

SEQ ID NO: 105367 - RNA, 1701 nt, Artificial Sequence
  derived and/or modified sequence opt2 from hemagglutinin__InfluenzaA__EPI578430
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccuccugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105368 - RNA, 1701 nt, Artificial Sequence
  derived and/or modified sequence opt2 from hemagglutinin__InfluenzaA__EPI614406
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccuccugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105369 - RNA, 1695 nt, Artificial Sequence
  derived and/or modified sequence opt2 from hemagglutinin__InfluenzaA__ACU65077/m1
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105370 - RNA, 1695 nt, Artificial Sequence; identical to SEQ ID NO: 105369
  derived and/or modified sequence opt2 from hemagglutinin__InfluenzaA__ACU65077/m2

SEQ ID NO: 105371 - RNA, 1707 nt, Artificial Sequence; identical to SEQ ID NO: 91540
  derived and/or modified sequence opt2 from hemagglutinin__InfluenzaA__ABP51976

SEQ ID NO: 105372 - RNA, 1707 nt, Artificial Sequence; identical to SEQ ID NO: 91540
  derived and/or modified sequence opt2 from hemagglutinin__InfluenzaA__ABP51976/m1

SEQ ID NO: 105373 - RNA, 1695 nt, Artificial Sequence
  derived and/or modified sequence opt2 from hemagglutinin__InfluenzaA__ABW90125
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuacugguccucccacgaggccucccucggcgucuccuccgccugccccuaccagggcaaguccuccuucuuccgcaacgucgucuggcucaccaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105374 - RNA, 1695 nt, Artificial Sequence
  derived and/or modified sequence opt2 from hemagglutinin__InfluenzaA__ABW90126
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagggcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105375 - RNA, 1695 nt, Artificial Sequence
  derived and/or modified sequence opt2 from hemagglutinin__InfluenzaA__ABW90127
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcgaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105376 - RNA, 1695 nt, Artificial Sequence
  derived and/or modified sequence opt2 from hemagglutinin__InfluenzaA__ABW90128
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucgagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105377 - RNA, 1695 nt, Artificial Sequence
  derived and/or modified sequence opt2 from hemagglutinin__InfluenzaA__ABW90129
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccgccuaccccaccaucaagcgcuccuacaacaacaccaaccaggaggaccuccucguccucuggggcauccaccaccccaacgacgccgccgagcagaccgagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105378 - RNA, 1695 nt, Artificial Sequence
  derived and/or modified sequence opt2 from hemagglutinin__InfluenzaA__ABW90130
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguucuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105379 - RNA, 1695 nt, Artificial Sequence
  derived and/or modified sequence opt2 from hemagglutinin__InfluenzaA__ABW90132
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacaacgccgccgagcagaccgagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105380 - RNA, 1695 nt, Artificial Sequence
  derived and/or modified sequence opt2 from hemagglutinin__InfluenzaA__ABW90133
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaagcccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105381 - RNA, 1695 nt, Artificial Sequence
  derived and/or modified sequence opt2 from hemagglutinin__InfluenzaA__ABW90134
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccaggagaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105382 - RNA, 1695 nt, Artificial Sequence
  derived and/or modified sequence opt2 from hemagglutinin__InfluenzaA__ABW90135
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaacaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105383 - RNA, 1695 nt, Artificial Sequence
  derived and/or modified sequence opt2 from hemagglutinin__InfluenzaA__HB649491
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagaagcacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105384 - RNA, 1683 nt, Artificial Sequence; identical to SEQ ID NO: 101500
  derived and/or modified sequence opt2 from hemagglutinin__InfluenzaA__EPI439507

SEQ ID NO: 105385 - RNA, 1701 nt, Artificial Sequence
  derived and/or modified sequence opt2 from hemagglutinin__InfluenzaA__EPI482777
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcgucgccccccuccaccucggcaagugcaacaucgccggcuggcuccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacaccaaccgcggcgucaccgccgccugcccccacgccggcgccaacuccuucuaccgcaaccucgucuggcucgucaagaagggcaacuccuaccccaagaucaacaaguccuacaucaacaacaaggagaaggagguccucguccucugggccauccaccaccccuccaccuccgccgaccagcagucccucuaccagaacgccgacgccuacgucuucgucggcuccucccgcuacucccgcaaguucgagcccgagaucgccacccgccccaagguccgcgaccaggccggccgcaugaacuacuacuggacccucgucgagcccggcgacaagaucaccuucgaggccaccggcaaccucgucgccccccgcuacgccuucgcccucaagcgcaacuccggcuccggcaucaucaucuccgacaccuccguccacgacugcgacaccaccugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105386 - RNA, 1701 nt, Artificial Sequence; identical to SEQ ID NO: 97096
  derived and/or modified sequence opt2 from hemagglutinin__InfluenzaA__EPI745532

SEQ ID NO: 105387 - RNA, 1701 nt, Artificial Sequence
  derived and/or modified sequence opt2 from hemagglutinin__InfluenzaA__EPI278594
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgaguccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105388 - RNA, 1701 nt, Artificial Sequence
  derived and/or modified sequence opt2 from hemagglutinin__InfluenzaA__AEE69009
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacaccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105389 - RNA, 1701 nt, Artificial Sequence; identical to SEQ ID NO: 94463
  derived and/or modified sequence opt2 from hemagglutinin__InfluenzaA__GQ280797

SEQ ID NO: 105390 - RNA, 1701 nt, Artificial Sequence; identical to SEQ ID NO: 94196
  derived and/or modified sequence opt2 from hemagglutinin__InfluenzaA__EPI178457

SEQ ID NO: 105391 - RNA, 1701 nt, Artificial Sequence; identical to SEQ ID NO: 94196
  derived and/or modified sequence opt2 from hemagglutinin__InfluenzaA__EPI176470

SEQ ID NO: 105392 - RNA, 1701 nt, Artificial Sequence
  derived and/or modified sequence opt2 from hemagglutinin__InfluenzaA__EPI280341
augaaggccauccucgucguccuccuccacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccacccucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105393 - RNA, 1701 nt, Artificial Sequence
  derived and/or modified sequence opt2 from hemagglutinin__InfluenzaA__EPI240319
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105394 - RNA, 1701 nt, Artificial Sequence; identical to SEQ ID NO: 94361
  derived and/or modified sequence opt2 from hemagglutinin__InfluenzaA__EPI183134

SEQ ID NO: 105395 - RNA, 1701 nt, Artificial Sequence
  derived and/or modified sequence opt2 from hemagglutinin__InfluenzaA__EPI368693
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccuccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105396 - RNA, 1701 nt, Artificial Sequence
  derived and/or modified sequence opt2 from hemagglutinin__InfluenzaA__EPI291788
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcgucgccccccuccaccucggcaagugcaacaucgccggcuggcuccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacaccaaccgcggcgucaccgccgccugcccccacgccggcaccaacuccuucuaccgcaaccucaucuggcucgucaagaagggcaacuccuaccccaagaucaacaaguccuacaucaacaacaaggagaaggagguccucguccucugggccauccaccaccccuccaccuccgccgaccagcagucccucuaccagaacgccgacgccuacgucuucgucggcuccucccgcuacucccgcaaguucgagcccgagaucgccacccgccccaagguccgcgaccaggccggccgcaugaacuacuacuggacccucgucgagcccggcgacaagaucaccuucgaggccaccggcaaccucgucgucccccgcuacgccuucgcccucaagcgcaacuccggcuccggcaucaucaucuccgacaccuccguccacgacugcgacaccaccugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105397 - RNA, 1701 nt, Artificial Sequence
  derived and/or modified sequence opt2 from hemagglutinin__InfluenzaA__EPI482788
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcgucgccccccuccaccucggcaagugcaacaucgccggcuggcuccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacaccaaccgcggcgucaccgccgccugcccccacgccggcaccaacuccuucuaccgcaaccucaucuggcucgucaagaagggcaacuccuaccccaagaucaacaaguccuacaucaacaacaaggagaaggagguccucguccucugggccauccaccaccccuccaccuccgccgaccagcaguccaucuaccagaacgccgacgccuacgucuucgucggcuccucccgcuacucccgcaaguucgagcccgagaucgccacccgccccaagguccgcgaccaggccggccgcaugaacuacuacuggacccucgucgagcccggcgacaagaucaccuucgaggccaccggcaaccucgucgucccccgcuacgccuucgcccucaagcgcaacuccggcuccggcaucaucaucuccgacaccuccguccacgacugcgacaccaccugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105398 - RNA, 1701 nt, Artificial Sequence
  derived and/or modified sequence opt2 from hemagglutinin__InfluenzaA__EPI178946/m1
augaaggccaucaucgucguccuccucuacaccuucgccaccgccgacgccgacacccucugcaucggcuaccacgccaacaacuccaccgacaccgucgacaccguccucgagaagaacgucaccgucacccacuccgucaaccuccucgagaacaagcacgacggcaagcucugcaagcuccgcggcgucgccccccuccaccucggcaagugcaacaucgccggcuggcuccucggcaaccccgagugcgagucccucuucaccgccuccuccugguccuacaucgucgagacccccaacuccgacaacggcaccugcuaccccggcgacuucaucaacuacgaggagcuccgcgagcaccucuccuccgucuccuccuucgagcgcuucgagaucuuccccaaggccaacuccuggcccaaccacgacaccaacaagggcgucaccgccgccugccccuacgccggcgccaacuccuucuaccgcaaccucaucuggcucgucaagaagggcaacuccuaccccaagcucuccaaguccuacaucaacaacaagaagaaggagguccucgucaucuggggcauccaccacccccccaccuccaccgaccagcagacccucuaccagaacgccgacgccuacgucuucgucggcuccuccaaguacuccaagcgcuucaagcccgagaucgccgcccgccccaagguccgcaaccaggccggccgcaugaacuacuacuggacccucaucgagcccggcgacaccaucaccuucgaggccaccggcaaccucgucgucccccgcuacgccuucgccaugaagcgcggcuccggcuccggcaucaucgucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuuccucgagggcggcuggaccggcaugaucgacggcugguacggcuaccaccaccagaacgagcagggcuccggcuacgccgccgaccagaaguccacccagaacgccaucgacggcaucaccaacaaggucaacuccaucaucgagaagaugaacacccaguucaccgccgucggcaaggaguucaaccagcucgagaagcgcaucgagucccucaacaacaaggucgacgacggcuuccucgacaucuggaccuacaacgccgagaugcucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccgcccgcaucuaccagauccucgccaucuacuccaccgucgccuccucccucguccuccucgucucccucggcgccgucuccuucuggaugugcuccaacggcucccuccagugccgcaucugcaucuga

SEQ ID NO: 105399 - RNA, 1701 nt, Artificial Sequence
  derived and/or modified sequence opt2 from hemagglutinin__InfluenzaA__EPI482791/m2
augaaggccaucaucgucguccuccucuacaccuucgccaccgccgacgccgacacccucugcaucggcuaccacgccaacaacuccaccgacaccgucgacaccguccucgagaagaacgucaccgucacccacuccgucaaccuccucgagaacaagcacgacggcaagcucugcaagcuccgcggcgucgccccccuccaccucggcaagugcaacaucgccggcuggcuccucggcaaccccgagugcgagucccucuucaccgccuccuccugguccuacaucgucgagacccccaacuccgacaacggcaccugcuaccccggcgacuucaucaacuacgaggagcuccgcgagcaccucuccuccgucuccuccuucgagcgcuucgagaucuuccccaaggccaacuccuggcccaaccacgagaccaacaagggcgucaccgccgccugccccuacgccggcgccaacuccuucuaccgcaaccucaucuggcucgucaagaagggcaacuccuaccccaagcucuccaaguccuacaucaacaacaagaagaaggagguccucgucaucuggggcauccaccacccccccaccuccaccgaccagcagacccucuaccagaacgccgacgccuacgucuucgucggcuccuccaaguacuccaagcgcuucaagcccgagaucgccgcccgccccaagguccgcaaccaggccggccgcaugaacuacuacuggacccucaucgagcccggcgacaccaucaccuucgaggccaccggcaaccucgucgucccccgcuacgccuucgccaugaagcgcggcuccggcuccggcaucaucgucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuuccucgagggcggcuggaccggcaugaucgacggcugguacggcuaccaccaccagaacgagcagggcuccggcuacgccgccgaccagaaguccacccagaacgccaucgacggcaucaccaacaaggucaacuccaucaucgagaagaugaacacccaguucaccgccgucggcaaggaguucaaccagcucgagaagcgcaucgagucccucaacaacaaggucgacgacggcuuccucgacaucuggaccuacaacgccgagaugcucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccgcccgcaucuaccagauccucgccaucuacuccaccgucgccuccucccucguccuccucgucucccucggcgccgucuccuucuggaugugcuccaacggcucccuccagugccgcaucugcaucuga

SEQ ID NO: 105400 - RNA, 1701 nt, Artificial Sequence
  derived and/or modified sequence opt2 from hemagglutinin__InfluenzaA__EPI291799
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcgucgccccccuccaccucggcaagugcaacaucgccggcuggcuccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacaccaaccgcggcgucaccgccgccugcccccacgccggcaccaacuccuucuaccgcaaccucaucuggcucgucaagaagggcaacuccuaccccaagaucaacaaguccuacaucaacaacaaggagaaggagguccucguccucugggccauccaccaccccuccaccuccgccgaccagcagucccucuaccagaacgccgacgccuacgucuucgucggcuccucccgcuacucccgcaaguucgagcccgagaucgccacccgccccaagguccgcgaccaggccggccgcaugaacuacuacuggacccucgucgagcccggcgacaagaucaccuucgaggccaccggcaaccucgucgucccccgcuacgccuucgcccucaagcgcaccuccggcuccggcaucaucaucuccgacaccuccguccacgacugcgacaccaccugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105401 - RNA, 1701 nt, Artificial Sequence
  derived and/or modified sequence opt2 from hemagglutinin__InfluenzaA__EPI482799
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcgucgccccccuccaccucggcaagugcaacaucgccggcuggcuccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgagaccaaccgcggcgucaccgccgccugcccccacgccggcaccaacuccuucuaccgcaaccucaucuggcucgucaagaagggcaacuccuaccccaagaucaacaaguccuacaucaacaacaaggagaaggagguccucguccucugggccauccaccaccccuccaccuccgccgaccagcagucccucuaccagaacgccgacgccuacgucuucgucggcuccucccgcuacucccgcaaguucgagcccgagaucgccacccgccccaagguccgcgaccaggccggccgcaugaacuacuacuggacccucgucgagcccggcgacaagaucaccuucgaggccaccggcaaccucgucgucccccgcuacgccuucgcccucaagcgcaccuccggcuccggcaucaucaucuccgacaccuccguccacgacugcgacaccaccugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105402 - RNA, 1701 nt, Artificial Sequence
  derived and/or modified sequence opt2 from hemagglutinin__InfluenzaA__EPI291807
augaaggccaucaucgucguccuccucuacaccuucgccaccgccgacgccgacacccucugcaucggcuaccacgccaacaacuccaccgacaccgucgacaccguccucgagaagaacgucaccgucacccacuccgucaaccuccucgagaacaagcacgacggcaagcucugcaagcuccgcggcgucgccccccuccaccucggcaagugcaacaucgccggcuggcuccucggcaaccccgagugcgagucccucuucgccgccuccuccugguccuacaucgucgagacccccaacuccgacaacggcaccugcuaccccggcgacuucaucaacuacgaggagcuccgcgagcaccucuccuccgucuccuccuucgagcgcuucgagaucuuccccaaggccaacuccuggcccaaccacgacaccaacaagggcgucaccgccgccugccccuacgccggcgccaacuccuucuaccgcaaccucaucuggcucgucaagaagggcaacuccuaccccaagcucuccaaguccuacaucaacaacaagaagaaggagguccucgucaucuggggcauccaccacccccccaccuccaccgaccagcagacccucuaccagaacgccgacgccuacgucuucgucggcuccuccaaguacuccaagcgcuucaagcccgagaucgccgcccgccccaagguccgcgaccaggccggccgcauggacuacuacuggacccucaucgagcccggcgacaccaucaccuucgaggccaccggcaaccucgucgucccccgcuacgccuucgccaugaagcgcggcuccggcuccggcaucaucgucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccaucaucgagaagaugaacacccaguucaccgccgucggcaaggaguucucccagcucgagaagcgcaucgagucccucaacaacaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccgcccgcaucuaccagauccucgccaucuacuccaccgucgccuccucccucguccuccucgucucccucggcgccgucuccuucuggaugugcuccaacggcucccuccagugccgcaucugcaucuga

SEQ ID NO: 105403 - RNA, 1701 nt, Artificial Sequence
  derived and/or modified sequence opt2 from hemagglutinin__InfluenzaA__EPI638970
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgagaacggcaccugcuaccccggcgacuucaucaacuacgaggagcuccgcgagcagcucuccuccgucuccuccuucgagcgcuucgagaucuuccccaagaccuccuccuggcccaaccacgacaccaacaagggcgucaccgccgccugcccccacuccggcaccaacuccuucuaccgcaaccucgucuggcucguccagaagggcaacuccuaccccaagaucaacaaguccuacaucaacaacaaggagaacgagguccucguccucugggccauccaccaccccuccaccuccgccgaccagcagucccucuacaagaacgccgacgccuacgucuucgucggcuccucccgcuacucccgcaaguucgagcccgagaucgccacccgccccaagguccgcgaccaggccggccgcaugaacuacuacuggacccucgucgagcccggcgacaagaucaccuucgaggccaccggcaaccucgucgccccccgcuacgccuucacccucaagcgcaacuccggcuccggcaucaucaucuccgacaccuccguccacgacugcgacaccaccugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaugugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 105404 - RNA, 1701 nt, Artificial Sequence
  derived and/or modified sequence opt2 from hemagglutinin__InfluenzaA__ABI19015
augaaggccaucaucgucguccuccucuacaccuucgccaccgccgacgccgacacccucugcaucggcuaccacgccaacaacuccaccgacaccgucgacaccguccucgagaagaacgucaccgucacccacuccgucaaccuccucgagaacaagcacgacggcaagcucugcaagcuccgcggcaucgccccccuccaccucggcaagugcaacaucgccggcuggauccucggcaaccccgagugcgagucccucuucaccaccuccuccugguccuacaucgucgagacccccaacuccgacaacggcaccugcuaccccggcgacuucaucaacuacgaggagcuccgcgagcaccucuccuccgucuccuccuucgagcgcuucgagaucuuccccaaggccaacuccuggcccuaccacgacaccaacaagggcgucaccgccgccugccccuacgccggcgccaacuccuucuaccgcaaccucaucuggcucgucaagaagggcaacuccuaccccaagcucuccaaguccuacaucaacaacaagaagaaggagguccucgucaucuggggcauccaccacccccccaccuccaccgaccagcagacccucuaccagaacgccgacgccuacgucuucgucggcuccuccaaguacuccaagcgcuucaagcccgagaucgccgcccgccccaagguccgcgaccaggccggccgcauggacuacuacuggacccucaucgagcccggcgacaccaucaccuucgaggccaccggcaaccucgucgucccccgcuacgccuucaccaugaagcgcggcuccggcuccggcaucaucgucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccaucaucgagaagaugaacacccaguucaccgccgucggcaaggaguucucccagcucgagaagcgcaucgagucccucaacaacaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgccaggagaucgacggcgucaagcucgaguccgcccgcaucuaccagauccucgccaucuacuccaccgucgccuccucccucguccuccucgucucccucggcgccgucuccuucuggaugugcuccaacggcucccuccagugccgcaucugcaucuga

SEQ ID NO: 105405 - RNA, 1701 nt, Artificial Sequence
  derived and/or modified sequence opt2 from hemagglutinin__InfluenzaA__EPI687790
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucggcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105406 - RNA, 1701 nt, Artificial Sequence
  derived and/or modified sequence opt2 from hemagglutinin__InfluenzaA__EPI841265
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucggcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcaguccaucuaccagaacgccgacgccuacgucuucgucggcaccucccgcuacuccaagaaguucaagcccgagaucgccacccgccccaagguccgcgaccaggagggccgcaucaacuacuacuggacccucgucgagcccggcgacaagaucaccuucgaggccaccggcaaccucgucgucccccgcuacgccuucaccauggagcgcaacgccggcuccggcaucaucaucuccaacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105407 - RNA, 1701 nt, Artificial Sequence
  derived and/or modified sequence opt2 from hemagglutinin__InfluenzaA__EPI291846
augaaggccaucaucgucguccuccucuacaccuucgccaccgccgacgccgacacccucugcaucggcuaccacgccaacaacuccaccgacaccgucgacaccguccucgagaagaacgucaccgucacccacuccgucaaccuccucgagaacaagcacgacggcaagcucugcaaccucaagggcgucgccccccuccaccucggcaagugcaacaucgccggcuggcuccucggcaaccccgagugcgagucccucuucaccgccuccuccugguccuacaucgucgagacccccaacuccgacaacggcaccugcuaccccggcgacuucaucaacuacgaggagcuccgcgagcaccucuccuccgucuccuccuucgagcgcuucgagaucuuccccaaggucaacuccuggcccaaccacgacaccaacaagggcgucaccgccgccugccccuacgccggcgccaacuccuucuaccgcaaccucaucuggcucgucaagaagggcaacuccuaccccaagcucuccaaguccuacaucaacaacaagaagaaggagguccucgucaucuggggcauccaccacccccccaccuccaccgaccagcagacccucuaccagaacgccgacgccuacgucuucgucggcuccuccaaguacuccaagcgcuucgagcccgagaucgccgcccgccccaagguccgcaaccaggccggccgcaugaacuacuacuggacccucaucgagcccggcgacaccaucaccuucgaggccaccggcaaccucgucgucccccgcuacgccuucgccaugcgccgcggcuccggcuccggcaucaucgucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuuccucgagggcggcuggaccggcaugaucgacggcugguacggcuaccaccaccagaacgagcagggcuccggcuacgccgccgaccagaaguccacccagaacgccaucgacggcaucaccaacaaggucaacuccaucaucgagaagaugaacacccaguucaccgccgucggcaaggaguucucccagcucgagaagcgcaucgagucccucaacaacaaggucgacgacggcuuccucgacaucuggaccuacaacgccgagaugcucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccguccgcaacggcaccuacgacuaccccaaguacuccgaggaggccaagcucaaccgcgaggagaucgacggcgucaagcucgaguccgcccgcaucuaccagauccucgccaucuacuccaccgucgccuccucccucguccuccucgucucccucggcgccgucuccuucuggaugugcuccaacggcucccuccagugccgcaucugcaucuga

SEQ ID NO: 105408 - RNA, 1695 nt, Artificial Sequence
  derived and/or modified sequence opt2 from hemagglutinin__InfluenzaA__EPI558121
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcgucgccccccuccaccucggcaagugcaacaucgccggcuggcuccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuucccccagaccuccuccuggcccaaccacgacaccaaccgcggcgucaccgccgccugcccccacgccggcaccaacuccuucuaccgcaaccucgucuggcucgucaagaagggcaacuccuacuccaagaucaacaaguccuacaucaacaacaaggagaaggagguccucguccucugggccauccaccaccccuccaccuccgccgaccagcagucccucuaccagaacgccgacgccuacgucuucgucggcuccucccgcuacucccgcaaguucgagcccgagaucgccacccgccccaagguccgcgaccaggccggccgcaugaacuacuacuggacccucgucgagcccggcgacaagaucaccuucgaggccaccggcaaccucgucgccccccgcuacgccuucgcccucaagcgcaacuccggcuccggcaucaucaucuccgacaccuccguccacgacugcgacaccaccugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucuga

SEQ ID NO: 105409 - RNA, 1701 nt, Artificial Sequence; identical to SEQ ID NO: 103953
  derived and/or modified sequence opt2 from hemagglutinin__InfluenzaA__EPI564139

SEQ ID NO: 105410 - RNA, 1701 nt, Artificial Sequence; identical to SEQ ID NO: 105198
  derived and/or modified sequence opt2 from hemagglutinin__InfluenzaA__EPI786706

SEQ ID NO: 105411 - RNA, 1701 nt, Artificial Sequence
  derived and/or modified sequence opt2 from hemagglutinin__InfluenzaA__EPI395313
augaaggccauccucaucguccuccucuacaccuucaccaccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcgucgccccccuccaccucggcaagugcaacaucgccggcuggcuccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacaccaaccgcggcgucaccgccgccugcccccacgccggcaccaaguccuucuacaagaaccucaucuggaucgccaagaagggcaacuccuaccccaagaucaacaaguccuacaucaacaacaaggagaaggagguccucguccucugggccauccaccaccccuccaccuccgccgaccagcagucccucuaccagaacgccgacgccuacgucuucgucggcuccucccgcuacucccgcaaguucgagcccgagaucgccacccgccccaagguccgcgaccaggccggccgcaugaacuacuacuggacccucgucgagcccggcgacaagaucaccuucgaggccaccggcaaccucgucgccccccgcuacgccuucgcccucaagcgcaacuccggcuccggcaucaucaucuccgacaccuccguccacgacugcgacaccaccugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaugugcauggaguccgucaagaacggcaccuacgacuaccccaaguacuccgaggaggccaagcucaaccgcgaggucaucgacggcgucaagcucgaguccacccgcaucuaccagauccucgccaucuacgccaccgucgccuccucccucguccucgucgucucccucggcgccaucuccuucuggaugugcuccaacggcucccuccagugccgcaucugcaucuga

SEQ ID NO: 105412 - RNA, 1701 nt, Artificial Sequence
  derived and/or modified sequence opt2 from hemagglutinin__InfluenzaA__EPI291696
augaaggccauccuccucguccuccucuacaccuucaccgccgccaacgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcguccccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccgaccacgagaccaaccgcggcgucaccgccgccugccccuacgccggcgccaacuccuucuaccgcaaccucaucuggcucgucaagaagggcaacuccuaccccaagcucuccaaguccuacgucaacaacaaggagaaggagguccucguccucuggggcauccaccacccccccaccuccaccgaccagcagucccucuaccagaacgccgacgccuacgucuucgucggcuccuccaaguacaacaagaaguucaagcccgagauggccgcccgccccaagguccgcggccaggccggccgcaugaacuacuacuggacccucgucgcccccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucguccucuccgucucccucggcgccaucuccuucuggaugugcuccaacggcucccuccagugccgcaucugcaucuga

SEQ ID NO: 105413 - RNA, 1701 nt, Artificial Sequence; identical to SEQ ID NO: 101343
  derived and/or modified sequence opt2 from hemagglutinin__InfluenzaA__ACU80014

SEQ ID NO: 105414 - RNA, 1701 nt, Artificial Sequence; identical to SEQ ID NO: 94181
  derived and/or modified sequence opt2 from hemagglutinin__InfluenzaA__EPI177400

SEQ ID NO: 105415 - RNA, 1701 nt, Artificial Sequence; identical to SEQ ID NO: 94624
  derived and/or modified sequence opt2 from hemagglutinin__InfluenzaA__ACT36512

SEQ ID NO: 105416 - RNA, 1704 nt, Artificial Sequence
  derived and/or modified sequence opt2 from hemagglutinin__InfluenzaA__AJE30344
auggagaagaucguccuccuccucgccgucaucucccucgucaaguccgaccagaucugcaucggcuaccacgccaacaacuccaccaagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcacccucaacgacuacgaggagcucaagcaccuccucucccgcaucaaccacuucgagaagaaccucaucaucccccgcuccuccuggcccaaccacgagaccucccucggcgucuccgccgccugccccuaccagggcgccuccuccuucuuccgcaacgucgucuggcucaucaagaagaacgacgccuaccccaccaucaagaucuccuacaacaacaccaaccgcgaggaccuccucauccucuggggcauccaccacuccaacaacgccgccgagcagaccaaccucuacaagaaccccgacaccuacgucuccgucggcaccuccacccucaaccagcgccucguccccaagaucgccacccgcucccaggucaacggccaguccggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuaccccaaguacuccgaggaggccauccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 105417 - RNA, 1701 nt, Artificial Sequence; identical to SEQ ID NO: 105396
  derived and/or modified sequence opt2 from hemagglutinin__InfluenzaA__EPI178948

SEQ ID NO: 105418 - RNA, 1701 nt, Artificial Sequence; identical to SEQ ID NO: 105396
  derived and/or modified sequence opt2 from hemagglutinin__InfluenzaA__EPI178949

SEQ ID NO: 105419 - RNA, 1701 nt, Artificial Sequence
  derived and/or modified sequence opt2 from hemagglutinin__InfluenzaA__EPI590132
augaaggccauccucaucguccuccucuacaccuucaccaccgccaacgccgacaagaucugcaucggcuaccacgccaacaacuccaccgacaccgucgacaccguccucgagaagaacgucaccgucacccacuccgucaaccuccucgagaacaagcacaacggcaagcucugcaagcuccgcggcgucgccccccuccaccucggcaagugcaacaucgccggcuggcuccucggcaaccccgagugcgagucccucgccaccgccuccuccugguccuacaucgucgagaccuccuccuccaacaacggcaccugcuaccccggcgacuucaucaacuacgaggagcuccgcgagcagcucuccuccgucuccuccuucgagaaguucgagaucuuccccaagaccuccuccuggcccaaccacgagaccaacaagggcgucaccgccgccugcccccacgccggcaccaacuccuucuacaagaaccucaucuggcucgucaagaaggagaacuccuaccccaagaucaacaucuccuacaccaacaaccgcggcaaggagguccucguccucugggccauccaccacccccccaccuccaccgaccagcagucccucuaccagaacgccaacuccuacgucuucgucggcuccucccgcuacucccgcaaguucgagcccgagaucgccacccgccccaagguccgcggccaggccggccgcaugaacuacuacuggacccucgucgagcccggcgacaagaucaccuucgaggccaccggcaaccucgucgucccccgcuacgccuucgcccucaagcgcaacuccggcuccggcaucaucaucuccgagacccccguccacgacugcgacaccaccugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuucaucgacaucuggaccuacaacgccgagcuccucguccuccucgagaacgagcgcacccucgacuaccacgacuccaacgucaagacccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcaucaagcucgaguccacccgcaucuaccagauccucgccaucuacuccaccgucgccuccucccucguccucgucgucucccucggcgccaucuccuucuggaugugcuccaacggcucccuccagugccgcgucugcaucuga

SEQ ID NO: 105420 - RNA, 1701 nt, Artificial Sequence; identical to SEQ ID NO: 93248
  derived and/or modified sequence opt2 from hemagglutinin__InfluenzaA__ABU80400

SEQ ID NO: 105421 - RNA, 1698 nt, Artificial Sequence
  derived and/or modified sequence opt2 from hemagglutinin__InfluenzaA__ABO21709
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacaaccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 105422 - RNA, 1701 nt, Artificial Sequence; identical to SEQ ID NO: 94168
  derived and/or modified sequence opt2 from hemagglutinin__InfluenzaA__CAZ65588

SEQ ID NO: 105423 - RNA, 1701 nt, Artificial Sequence; identical to SEQ ID NO: 105198
  derived and/or modified sequence opt2 from hemagglutinin__InfluenzaA__EPI697744

SEQ ID NO: 105424 - RNA, 1701 nt, Artificial Sequence; identical to SEQ ID NO: 105358
  derived and/or modified sequence opt2 from hemagglutinin__InfluenzaA__EPI768525

SEQ ID NO: 105425 - RNA, 1701 nt, Artificial Sequence
  derived and/or modified sequence opt2 from hemagglutinin__InfluenzaA__EPI726930
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105426 - RNA, 1701 nt, Artificial Sequence
  derived and/or modified sequence opt2 from hemagglutinin__InfluenzaA__EPI813817
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccaggaggcccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105427 - RNA, 1701 nt, Artificial Sequence
  derived and/or modified sequence opt2 from hemagglutinin__InfluenzaA__EPI466626
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccuccgucguccucgucgucucccucggcgccaucuccuucuggaugugcuccaacggcucccuccagugccgcaucugcaucuga

SEQ ID NO: 105428 - RNA, 1701 nt, Artificial Sequence
  derived and/or modified sequence opt2 from hemagglutinin__InfluenzaA__EPI541966
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccuccgucguccucgucgucucccucggcgccaucuccuucuggaugugcuccaacggcucccuccagugccgcaucugcaucuga

SEQ ID NO: 105429 - RNA, 1701 nt, Artificial Sequence
  derived and/or modified sequence opt2 from hemagglutinin__InfluenzaA__EPI652003
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccacccccccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccuccgucguccucgucgucucccucggcgccaucuccuucuggaugugcuccaacggcucccuccagugccgcaucugcaucuga

SEQ ID NO: 105430 - RNA, 1701 nt, Artificial Sequence
  derived and/or modified sequence opt2 from hemagglutinin__InfluenzaA__EPI291877
augaaggccaucaucgucguccuccucuacaccuucgccaccgccgacgccgacacccucugcaucggcuaccacgccaacaacuccaccgacaccgucgacaccguccucgagaagaacgucaccgucacccacuccgucaacauccucgagaacaagcacgacggcaagcucugcaagcuccgcggcgucgccccccuccaccucggcaagugcaacaucgccggcuggcuccucggcaaccccgagugcgagucccucuucgccgccuccuccugguccuacaucgucgagacccccaacuccgacaacggcaccugcuaccccggcgacuucaucaacuacgaggagcuccgcgagcaccucuccuccgucuccuccuucgagcgcuucgagaucuuccccaaggccaacuccuggcccaaccacgacaccaacaagggcgucaccgccgccugccccuacgccggcgccaacuccuucuaccgcaaccucaucuggcucgucaagaagggcaacuccuaccccaagcucuccaaguccuacaucaacaacaagaagaaggagguccucgucaucuggggcauccaccacccccccaccuccaucgaccagcagacccucuaccagaacgccgacgccuacgucuucgucggcuccuccaaguacuccaagcgcuucaagcccgagaucgccgcccgccccaagguccgcgaccaggccggccgcauggacuacuacuggacccucaucgagcccggcgacaccaucaccuucgaggccaccggcaaccucgucgucccccgcuacgccuucgccaugaagcgcggcuccggcuccggcaucaucgucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccaucaucgagaagaugaacacccaguucaccgccgucggcaaggaguucucccagcucgagaagcgcaucgagucccucaacaacaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcaucaagcucgaguccgcccgcaucuaccagauccucgccaucuacuccaccgucgccuccucccucguccuccucgucucccucggcgccgucuccuucuggaugugcuccaacggcucccuccagugccgcaucugcaucuga

SEQ ID NO: 105431 - RNA, 1701 nt, Artificial Sequence
  derived and/or modified sequence opt2 from hemagglutinin__InfluenzaA__ABR29595
augaaggccauccuccucguccuccucuacaccuucaccgccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcgucaccgccgccugccccuacgccggcgccaacuccuucuaccgcaaccucaucuggcucgucaagaagggcaacuccuaccccaagcucuccaaguccuacgucaacaacaaggagaaggagguccucguccucuggggcauccaccacccccccaccuccaccgaccagcagucccucuaccagaacgccgacgccuacgucuucgucggcuccuccaaguacaacaagaaguucaagcccgagaucgccacccgccccaagguccgcggccaggccggccgcaugaacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 105432 - RNA, 1701 nt, Artificial Sequence
  derived and/or modified sequence opt2 from hemagglutinin__InfluenzaA__EPI291885
augaaggccaucaucgucguccuccuccacaccuucgccaccgccgacgccgacacccucugcaucggcuaccacgccaacaacuccaccgacaccgucgacaccguccucgagaagaacgucaccgucacccacuccgucaaccuccucgagaccaagcacgacggcaagcucugcaaccucaagggcgucgccccccuccaccucggcaagugcaacaucgccggcuggcuccucggcaaccccgagugcgagucccucuucaccgccuccuccugguccuacaucgucgagacccccaacuccgacaacggcaccugcuaccccggcaacuucaucaacuacgaggagcuccgcgagcaccucuccuccgucuccuccuucgagcgcuucgagaucuuccccaaggccaacuccuggcccaaccacgacaccaacaagggcgucaccgccgccugccccuacgccggcgccaacuccuucuaccgcaaccucaucuggcucgucaagaagggcaacuccuaccccaagcucuccaaguccuacaucaacaacaagaagaaggagguccucgucaucuggggcauccaccacccccccaccuccaccgaccagcagacccucuaccagaacgccgacgccuacgucuucgucggcuccuccaaguacuccaagcgcuucgagcccgagaucgccgcccgccccaagguccgcaaccaggccggccgcaugaacuacuacuggacccucaucgagcccggcgacaccaucaccuucgaggccaccggcaaccucgucgucccccgcuacgccuucgccaugcgccgcggcuccggcuccggcaucaucgucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuuccucgagggcggcuggaccggcaugaucgacggcugguacggcuaccaccaccagaacgagcagggcuccggcuacgccgccgaccagaaguccacccagaacgccaucgacggcaucaccaacaaggucaacuccaucaucgagaagaugaacacccaguucaccgccgucggcaaggaguucucccagcucgagaagcgcaucgagucccucaacaacaaggucgacgacggcuuccucgacaucuggaccuacaacgccgagaugcucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccgcccgcaucuaccagauccucgccaucuacuccaccgucgccuccucccucguccuccucgucucccucggcgccgucuccuucuggaugugcuccaacggcucccuccagugccgcaucugcaucuga

SEQ ID NO: 105433 - RNA, 1701 nt, Artificial Sequence; identical to SEQ ID NO: 94168
  derived and/or modified sequence opt2 from hemagglutinin__InfluenzaA__EPI176515

SEQ ID NO: 105434 - RNA, 1701 nt, Artificial Sequence; identical to SEQ ID NO: 94624
  derived and/or modified sequence opt2 from hemagglutinin__InfluenzaA__EPI189182

SEQ ID NO: 105435 - RNA, 1701 nt, Artificial Sequence; identical to SEQ ID NO: 94416
  derived and/or modified sequence opt2 from hemagglutinin__InfluenzaA__EPI180574

SEQ ID NO: 105436 - RNA, 1701 nt, Artificial Sequence; identical to SEQ ID NO: 100221
  derived and/or modified sequence opt2 from hemagglutinin__InfluenzaA__EPI377499

SEQ ID NO: 105437 - RNA, 1701 nt, Artificial Sequence
  derived and/or modified sequence opt2 from hemagglutinin__InfluenzaA__EPI346916
augaaggccauccucgucguccuccucuacaccuucaccaccgccaccgccgacacccucugcaucggcuaccacgccaacaacuccaccgacaccgucgacaccguccucgagaagaacgucaccgucacccacuccgucaaccuccucgagaaccgccacaacggcaagcucugcaagcuccgcggcgucgccccccuccaccucggcaagugcaacaucgccggcuggcuccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacaccaaccgcggcgucaccgccgccugcccccacgacggcaccaacuccuucuaccgcaaccucaucuggcucgucaagaagggcaacuccuaccccaagaucaacaaguccuacaucaacaacaaggagaaggagauccucguccucugggccauccaccaccccuccaccuccgccgaccagcagucccucuaccagaacgccgacgccuacgucuucgucggcuccucccgcuacucccgcaaguucgagcccgaggucgccacccgccccaagguccgcgaccaggccggccgcaugaacuacuacuggacccucgucgagcccggcgacaagaucaccuucgaggccaccggcaaccucgucgucccccgcuacgccuucgcccucaagcgcaacuccggcuccggcaucaucaucuccgacaccuccguccacgacugcgacaccaacugccagacccccaacggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucucccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 105438 - RNA, 1689 nt, Artificial Sequence; identical to SEQ ID NO: 94795
  derived and/or modified sequence opt2 from hemagglutinin__InfluenzaA__ACV49600

SEQ ID NO: 105439 - RNA, 1701 nt, Artificial Sequence; identical to SEQ ID NO: 93841
  derived and/or modified sequence opt2 from hemagglutinin__InfluenzaA__BAF48361

SEQ ID NO: 105440 - RNA, 1701 nt, Artificial Sequence
  derived and/or modified sequence opt2 from hemagglutinin__InfluenzaA__EPI507594
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacuccuccuucuucucccgccucaacuggcucacccaccucaacuucaaguaccccgcccucaacgucaccaugcccaacaacgagcaguucgacaagcucuacaucuggggcguccaccaccccgucaccgacaaggaccagaucuuccucuacgcccaguccuccggccgcaucaccgucuccaccaagcgcucccagcaggccgucauccccaacaucggcuuccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuucgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105441 - RNA, 1701 nt, Artificial Sequence
  derived and/or modified sequence opt2 from hemagglutinin__InfluenzaA__EPI461953
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuucgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105442 - RNA, 1701 nt, Artificial Sequence
  derived and/or modified sequence opt2 from hemagglutinin__InfluenzaA__EPI461953/m1
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacuccuccuucuucucccgccucaacuggcucacccaccucaacuucaaguaccccgcccucaacgucaccaugcccaacaacgagcaguucgacaagcucuacaucuggggcguccaccaccccgucaccgacaaggaccagaucuuccucuacgcccaguccuccggccgcaucaccgucuccaccaagcgcucccagcaggccgucauccccaacaucggcuaccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuucgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105443 - RNA, 1701 nt, Artificial Sequence
  derived and/or modified sequence opt2 from hemagglutinin__InfluenzaA__EPI668105
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaccgucuccaccaagcgcucccagcaggccgucauccccaacaucggcucccgcccccgcauccgcggcauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105444 - RNA, 1701 nt, Artificial Sequence
  derived and/or modified sequence opt2 from hemagglutinin__InfluenzaA__EPI578446
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaccgucuccaccaagcgcucccagcaggccgucauccccaacaucggcucccgcccccgcauccgcggcauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105445 - RNA, 1701 nt, Artificial Sequence; identical to SEQ ID NO: 103953
  derived and/or modified sequence opt2 from hemagglutinin__InfluenzaA__EPI551882

SEQ ID NO: 105446 - RNA, 1701 nt, Artificial Sequence
  derived and/or modified sequence opt2 from hemagglutinin__InfluenzaA__EPI344389
augaagaccaucaucgccuucuccugcauccucugccucaucuucgcccagaagcuccccggcuccgacaacuccauggccacccucugccucggccaccacgccguccccaacggcacccucgucaagaccaucaccgacgaccagaucgaggucaccaacgccaccgagcucguccaguccuccuccaccggccgcaucugcaacuccccccaccagauccucgacggcaagaacugcacccucaucgacgcccuccucggcgacccccacugcgacgaccuccagaacaaggagugggaccucuucgucgagcgcuccaccgccuacuccaacugcuaccccuacuacguccccgacuacgccacccuccgcucccucgucgccuccuccggcaaccucgaguucacccaggaguccuucaacuggaccggcgucgcccaggacggcuccuccuacgccugccgccgcggcuccgucaacuccuucuucucccgccucaacuggcucuacaaccucaacuacaaguaccccgagcagaacgucaccaugcccaacaacgacaaguucgacaagcucuacaucuggggcguccaccaccccggcaccgacaaggaccagaccaaccucuacguccaggccuccggccgcgucaucgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccaguccggcaaguccuccaucaugcgcuccgacgcccacaucgacgagugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaccggcaagcucaaccgcgucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagcgcacccgccgccagcuccgcgagaacgccgaggacaugggcaacggcugcuucaagaucuaccacaagugcgacaacgccugcaucggcuccauccgcaacggcaccuacgaccacgacaucuaccgcaacgaggcccucaacaaccgcuuccagaucaagggcguccagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 105447 - RNA, 1701 nt, Artificial Sequence
  derived and/or modified sequence opt2 from hemagglutinin__InfluenzaA__EPI348782
augaagaccaucaucgccuucuccugcauccucugccucaucuucgcccagaagcuccccggcuccgacaacuccauggccacccucugccucggccaccacgccguccccaacggcacccucgucaagaccaucaccgacgaccagaucgaggucaccaacgccaccgagcucguccaguccuccuccaccggccgcaucugcaacuccccccaccagauccucgacggcaagaacugcacccucaucgacgcccuccucggcgacccccacugcgacgaccuccagaacaaggagugggaccucuucgucgagcgcuccaccgccuacuccaacugcuaccccuacuacguccccgacuacgccacccuccgcucccucgucgccuccuccggcaaccucgaguucacccaggaguccuucaacuggaccggcgucgcccaggacggcuccuccuacgccugccgccgcggcuccgucaacuccuucuucucccgccucaacuggcucuacaagcucaacuacaaguaccccgagcagaacgucaccaugcccaacaacgacaaguucgacaagcucuacaucuggggcguccaccaccccggcaccgacaaggaccagaccaacaucuacguccaggccuccggccgcgucaucgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccaguccggcaaguccuccaucaugcgcuccgacgcccacaucgacgagugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaccggcaagcucaaccgcgucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagcgcacccgccgccagcuccgcgagaacgccgaggacaugggcaacggcugcuucaagaucuaccacaagugcgacaacgccugcaucggcuccauccgcaacggcaccuacgaccacgacaucuaccgcaacgaggcccucaacaaccgcuuccagaucaagggcguccagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 105448 - RNA, 1701 nt, Artificial Sequence
  derived and/or modified sequence opt2 from hemagglutinin__InfluenzaA__EPI642513
augaagaccaucaucgccuucuccugcauccucugccucaucuucgcccagaagcuccccggcuccgacaaguccauggccacccucugccucggccaccacgccguccccaacggcacccucgucaagaccaucaccgacgaccagaucgaggucaccaacgccaccgagcucguccaguccuccuccaccucccgcaucugcaacuccccccaccagauccucgacggcaagaacugcacccucaucgacgcccuccucggcgacccccacugcgacgacuuccagaacaagaagugggaccucuucgucgagcgcuccaccgccuacuccaacugcuaccccuacuacguccccgacuacgccacccuccgcucccucaucgccuccuccggcaaccucgaguucacccaggaguccuucaacuggaccggcgucgcccaggacggcuccuccuacgccugccgccgcggcuccgucaacuccuucuucucccgccucaacuggcucuacaaccucaacuacaaguaccccgagcagaacgucaccaugcccaacaacgacaaguucgacaagcucuacaucuggggcguccaccaccccggcaccgacaaggaccagaccaaccucuacguccaggccuccggccgcgucaucgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccaguccggcaaguccuccaucaugcgcuccgacgcccacaucgacgagugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaccggcaagcucaaccgcgucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagcgcacccgccgccagcuccgcgagaacgccgaggacaugggcaacggcugcuucaagaucuaccacaagugcgacaacgccugcaucggcuccauccgcaacggcaccuacgaccacgacaucuaccgcaacgaggcccucaacaaccgcuuccagaucaagggcguccagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 105449 - RNA, 1701 nt, Artificial Sequence
  derived and/or modified sequence opt2 from hemagglutinin__InfluenzaA__EPI293965
augaagaccaucaucgccuucuccugcauccucugccucaucuucgcccagaagcuccccggcuccgacaacuccauggccacccucugccucggccaccacgccguccccaacggcacccucgucaagaccaucaccgacgaccagaucgaggucaccaacgccaccgagcucguccaguccuccuccaccggccgcaucugcaacuccccccaccagauccucgacggcaagaacugcacccucaucgacgcccuccucggcgacccccacugcgacgacuuccagaacaaggagugggaccucuucgucgagcgcuccaccgccuacuccaacugcuaccccuacuacguccccgacuacgccacccuccgcucccucgucgccuccuccggcaaccucgaguucacccaggaguccuucaacuggaccggcgucgcccaggacggcuccuccuacgccugccgccgcggcuccgucaacuccuucuucucccgccucaacuggcucuacaaccucaacuacaaguaccccgagcagaacgucaccaugcccaacaacgacaaguucgacaagcucuacaucuggggcguccaccaccccggcaccgacaaggaccagaccaaccucuacguccaggccuccggccgcgucaucgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccaguccggcaaguccuccaucaugcgcuccgacgcccacaucgacgagugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaccggcaagcucaaccgcgucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagcgcacccgccgccagcuccgcgagaacgccgaggacaugggcaacggcugcuucaagaucuaccacaagugcgacaacgccugcaucggcuccauccgcaacggcaccuacgaccacgacaucuaccgcaacgaggcccucaacaaccgcuuccagaucaagggcguccagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 105450 - RNA, 1701 nt, Artificial Sequence
  derived and/or modified sequence opt2 from hemagglutinin__InfluenzaA__EPI465400
augaagaccaucaucgccuucuccugcauccucugccucaucuucgcccagaagcuccccggcuccgacaacuccauggccacccucugccucggccaccacgccguccccaacggcacccucgucaagaccaucaccgacgaccagaucgaggucaccaacgccaccgagcucguccaguccuccuccaccggccgcaucugcaacuccccccaccagauccucgacggcaagaacugcacccucaucgacgcccuccucggcgacccccacugcgacgacuuccagaacaaggagugggaccucuucgucgagcgcuccaccgccuacuccaacugcuaccccuacuacguccccgacuacgccacccuccgcucccucgucgccuccuccggcaaccucgaguucacccaggaguccuucaacuggaccggcgucgcccaggacggcuccuccuacgccugccgccgcggcuccgucaacuccuucuucucccgccucaacuggcucuacaaccucaacuacaaguaccccgagcagaacgucaccaugcccaacaacgacaaguucgacaagcucuacaucuggggcguccaccaccccggcaccgacaaggaccagaccaagcucuacguccaggccuccggccgcgucaucgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccaguccggcaaguccuccaucaugcgcuccgacgcccacaucgacgagugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaccggcaagcucaaccgcgucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagcgcacccgccgccagcuccgcgagaacgccgaggacaugggcaacggcugcuucaagaucuaccacaagugcgacaacgccugcaucggcuccauccgcaacggcaccuacgaccacgacaucuaccgcaacgaggcccucaacaaccgcuuccagaucaagggcguccagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 105451 - RNA, 1701 nt, Artificial Sequence
  derived and/or modified sequence opt2 from hemagglutinin__InfluenzaA__EPI328898
augaagaccaucaucgccuucuccugcauccucugccucaucuucgcccagaagcuccccggcuccgacaacuccauggccacccucugccucggccaccacgccguccccaacggcacccucgucaagaccaucaccgacgaccagaucgaggucaccaacgccaccgagcucguccaguccuccuccaccggccgcaucugcaacuccccccaccagauccucgacggcaagaacugcacccucaucgacgcccuccucggcgacccccacugcgacgacuuccagaacaaggagugggaccucuucgucgagcgcuccaccgccuacuccaacugcuaccccuacuacguccccgacuacgccacccuccgcucccucgucgccuccuccggcaaccucgaguucacccaggaguccuucaacuggaccggcgucgcccaggacggcuccuccuacgccugccgccgcggcuccgucaacuccuucuucucccgccucaacuggcucuacaaccucaacuacaaguaccccgagcagaacgucaccaugcccaacaacgacaaguucgacaagcucuacaucuggggcguccaccaccccggcaccgacaaggaccagaccaagaucuacguccaggccuccggccgcgucaucgucuccaccaagcgcucccagcagaccgucauccccaacaucggcucccgccccuggguccgcggcgucuccuccaucaucuccaucuacuggaccaucgucaagcccggcgacauccuccucaucaacuccaccggcaaccucaucgccccccgcggcuacuucaagauccaguccggcaaguccuccaucaugcgcuccgacgcccacaucgacgagugcaacuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaccggcaagcucaaccgcgucaucaagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagcgcacccgccgccagcuccgcgagaacgccgaggacaugggcaacggcugcuucaagaucuaccacaagugcgacaacgccugcaucggcuccauccgcaacggcaccuacgaccacgacaucuaccgcaacgaggcccucaacaaccgcuuccagaucaagggcguccagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 105452 - RNA, 1701 nt, Artificial Sequence; identical to SEQ ID NO: 105451
  derived and/or modified sequence opt2 from hemagglutinin__InfluenzaA__EPI328900

SEQ ID NO: 105453 - RNA, 1701 nt, Artificial Sequence
  derived and/or modified sequence opt2 from hemagglutinin__InfluenzaA__EPI574644
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccacuccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105454 - RNA, 1701 nt, Artificial Sequence
  derived and/or modified sequence opt2 from hemagglutinin__InfluenzaA__EPI563212
augaagaccaucaucgcccucuccuacauccucugccucgucuucgcccagaagauccccggcaacgacaacaacaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaccgucuccaccaagcgcucccagcaggccgucauccccaacaucggcucccgcccccgcauccgcggcauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105455 - RNA, 1701 nt, Artificial Sequence; identical to SEQ ID NO: 105454
  derived and/or modified sequence opt2 from hemagglutinin__InfluenzaA__EPI553999

SEQ ID NO: 105456 - RNA, 1701 nt, Artificial Sequence
  derived and/or modified sequence opt2 from hemagglutinin__InfluenzaA__EPI551570
augaagaccaucaucgcccucuccuacauccucugccucgucuucgcccagaagauccccggcaacgacaacaacaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105457 - RNA, 1701 nt, Artificial Sequence
  derived and/or modified sequence opt2 from hemagglutinin__InfluenzaA__EPI629738
augaagaccaucaucgcccucuccuacauccucugccucgucuucgcccagaagauccccggcaacgacaacaacaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaucgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105458 - RNA, 1701 nt, Artificial Sequence
  derived and/or modified sequence opt2 from hemagglutinin__InfluenzaA__EPI631887
augaagaccaucaucgcccucuccuacauccucugccucgucuucgcccagaagauccccggcaacgacaacaacaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaucgucuccaccaagcgcucccagcaggccgucauccccaacaucggcucccgcccccgcauccgcgacucccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105459 - RNA, 1701 nt, Artificial Sequence
  derived and/or modified sequence opt2 from hemagglutinin__InfluenzaA__EPI577026
augaagaccaucaucgcccucuccuacauccucugccucgucuucgcccagaagauccccggcaacgacaacaacaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaccgucuccaccaagcgcucccagcaggccgucauccccaacaucggcucccgcccccgcauccgcggcauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgaguccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105460 - RNA, 1701 nt, Artificial Sequence; identical to SEQ ID NO: 101506
  derived and/or modified sequence opt2 from hemagglutinin__InfluenzaA__EPI404927

SEQ ID NO: 105461 - RNA, 1701 nt, Artificial Sequence
  derived and/or modified sequence opt2 from hemagglutinin__InfluenzaA__EPI489319
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105462 - RNA, 1701 nt, Artificial Sequence; identical to SEQ ID NO: 103939
  derived and/or modified sequence opt2 from hemagglutinin__InfluenzaA__EPI530647

SEQ ID NO: 105463 - RNA, 1701 nt, Artificial Sequence; identical to SEQ ID NO: 103953
  derived and/or modified sequence opt2 from hemagglutinin__InfluenzaA__EPI541083

SEQ ID NO: 105464 - RNA, 1701 nt, Artificial Sequence
  derived and/or modified sequence opt2 from hemagglutinin__InfluenzaA__EPI684315
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaucgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105465 - RNA, 1701 nt, Artificial Sequence
  derived and/or modified sequence opt2 from hemagglutinin__InfluenzaA__EPI614462
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccacccgccgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105466 - RNA, 1701 nt, Artificial Sequence
  derived and/or modified sequence opt2 from hemagglutinin__InfluenzaA__EPI541465
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacaacuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccacccgccgcucccagcaggccgucauccccaacaucggcucccgcccccgcauccgcggcauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105467 - RNA, 1701 nt, Artificial Sequence
  derived and/or modified sequence opt2 from hemagglutinin__InfluenzaA__EPI696967
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccgccucaacuccaaguaccccgcccucaacgucaccaugcccaacaacgagcaguucgacaagcucuacaucuggggcguccaccaccccgagaccgacaaggaccagaucuuccucuacgcccaguccuccggccgcaucaccgucuccacccgccgcucccagcaggccgucauccccaacaucggcucccgcccccgcauccgcggcauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105468 - RNA, 1701 nt, Artificial Sequence
  derived and/or modified sequence opt2 from hemagglutinin__InfluenzaA__EPI674597
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacaacuccuucuucucccgccucaacuggcucacccaccucaacuccaaguaccccgcccucaacgucaccaugcccaacaacgagcaguucgacaagcucuacaucuggggcguccaccaccccgucaccgacaaggaccagaucuuccucuacgcccaguccuccggccgcaucaccgucuccacccgccgcucccagcaggccgucauccccaacaucggcucccgcccccgcauccgcggcauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105469 - RNA, 1701 nt, Artificial Sequence
  derived and/or modified sequence opt2 from hemagglutinin__InfluenzaA__EPI530677
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105470 - RNA, 1701 nt, Artificial Sequence
  derived and/or modified sequence opt2 from hemagglutinin__InfluenzaA__EPI530679
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105471 - RNA, 1701 nt, Artificial Sequence; identical to SEQ ID NO: 91534
  derived and/or modified sequence opt2 from hemagglutinin__InfluenzaA__AAG01785

SEQ ID NO: 105472 - RNA, 1701 nt, Artificial Sequence; identical to SEQ ID NO: 103939
  derived and/or modified sequence opt2 from hemagglutinin__InfluenzaA__EPI814528

SEQ ID NO: 105473 - RNA, 1701 nt, Artificial Sequence
  derived and/or modified sequence opt2 from hemagglutinin__InfluenzaA__EPI674736
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugccgccgcggcuccaacuccuccuucuucucccgccucaacuggcucacccaccucaacuccaaguaccccgcccucaacgucaccaugcccaacaacgagcaguucgacaagcucuacaucuggggcguccaccaccccgucaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105474 - RNA, 1701 nt, Artificial Sequence; identical to SEQ ID NO: 103939
  derived and/or modified sequence opt2 from hemagglutinin__InfluenzaA__EPI614444

SEQ ID NO: 105475 - RNA, 1701 nt, Artificial Sequence
  derived and/or modified sequence opt2 from hemagglutinin__InfluenzaA__EPI551814
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugccgccgcggcuccaacuccuccuucuucucccgccucaacuggcucacccgccucaacuccaaguaccccgcccucaacgucaccaugcccaacaacgagcaguucgacaagcucuacaucuggggcguccaccaccccgucaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105476 - RNA, 1701 nt, Artificial Sequence
  derived and/or modified sequence opt2 from hemagglutinin__InfluenzaA__EPI696955
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugccgccgcggcuccaacuccuccuucuucucccgccucaacuggcucacccaccucaacuccaaguaccccgcccucaacgucaccaugcccaacaacgagcaguucgacaagcucuacaucuggggcguccaccaccccgucaccgacaaggaccagaucuuccucuacgcccaguccuccggccgcaucaccgucuccaccaagcgcucccagcaggccgucauccccaacaucggcuaccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105477 - RNA, 1701 nt, Artificial Sequence
  derived and/or modified sequence opt2 from hemagglutinin__InfluenzaA__EPI740790
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugccgccgcggcuccaacuccuccuucuucucccgccucaacuggcucacccaccucaacuccaaguaccccgcccucaacgucaccaugcccaacaacgagcaguucgacaagcucuacaucuggggcguccaccaccccgucaccgacaaggaccagaucuuccucuacgcccaguccuccggccgcaucaccgucuccaccaagcgcucccagcaggccgucauccccaacaucggcuuccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105478 - RNA, 1701 nt, Artificial Sequence; identical to SEQ ID NO: 100221
  derived and/or modified sequence opt2 from hemagglutinin__InfluenzaA__EPI377499

SEQ ID NO: 105479 - RNA, 1701 nt, Artificial Sequence
  derived and/or modified sequence opt2 from hemagglutinin__InfluenzaA__EPI391247
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaacggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccgucaccgacaaggaccagaucuuccucuacgcccagcccuccggccgcaucaccgucuccaccaagcgcucccagcaggccgucauccccaacaucggcuuccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105480 - RNA, 1701 nt, Artificial Sequence
  derived and/or modified sequence opt2 from hemagglutinin__InfluenzaA__EPI407123
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaacggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccgucaccgacaaggaccagaucuuccucuacgcccagcccuccggccgcaucaccgucuccaccaagcgcucccagcaggccgucauccccaacaucggcuuccgcccccgcauccgcaacaaccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcgagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105481 - RNA, 1701 nt, Artificial Sequence
  derived and/or modified sequence opt2 from hemagglutinin__InfluenzaA__EPI407126
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaacggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccgucaccgacaaggaccagaucuuccucuacgcccagcccuccggccgcaucaccgucuccaccaagcgcucccagcaggccgucauccccaacaucggcuuccgcccccgcauccgcaacaaccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105482 - RNA, 1701 nt, Artificial Sequence; identical to SEQ ID NO: 105367
  derived and/or modified sequence opt2 from hemagglutinin__InfluenzaA__EPI562037

SEQ ID NO: 105483 - RNA, 1701 nt, Artificial Sequence; identical to SEQ ID NO: 103953
  derived and/or modified sequence opt2 from hemagglutinin__InfluenzaA__EPI562034

SEQ ID NO: 105484 - RNA, 1701 nt, Artificial Sequence
  derived and/or modified sequence opt2 from hemagglutinin__InfluenzaA__EPI653140
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccuccugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaaguaccccgcccucaacgucaccaugcccaacaacgagcaguucgacaagcucuacaucuggggcguccaccaccccggcaccgacaaggaccagaucuuccccuacgcccaguccuccggccgcaucaccgucuccaccaagcgcucccagcaggccgucauccccaacaucggcucccgcccccgcauccgcggcauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 105485 - RNA, 1707 nt, Artificial Sequence
  derived and/or modified sequence opt2 from hemagglutinin__InfluenzaA__ACR48873/m
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucgagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105486 - RNA, 1707 nt, Artificial Sequence
  derived and/or modified sequence opt2 from hemagglutinin__InfluenzaA__ACR48874/m
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaaggacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 105487 - RNA, 1701 nt, Artificial Sequence; identical to SEQ ID NO: 100658
  derived and/or modified sequence opt2 from hemagglutinin__InfluenzaA__ACD47234

SEQ ID NO: 105488 - RNA, 1707 nt, Artificial Sequence
  derived and/or modified sequence opt2 from hemagglutinin__InfluenzaA__ACZ36881
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105489 - RNA, 1704 nt, Artificial Sequence
  derived and/or modified sequence opt2 from hemagglutinin__InfluenzaA__EPI500771
auggagaagaucguccuccucuucgccaccaucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaacccccucugcgacgaguucaccaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaggacuccugguccgaccacgaggccucccucggcgucuccgccgccugcuccuaccagggcaacuccuccuucuuccgcaacgucgucuggcucaucaagaaggacaacgccuaccccaccaucaagaagggcuacaacaacaccaaccgcgaggaccuccucauccucuggggcauccaccaccccaacgacgaggccgagcagaccaagcucuaccagaaccccaccaccuacaucuccaucggcaccuccacccucaaccagcgccucguccccaagaucgccacccgcuccaagaucaaccgccaguccggccgcaucgacuucuucuggaccauccucaagcccaacgacgccauccacuucgaguccaacggcaacuucaucgcccccgaguacgccuacaagaucgucaagaagggcgacuccaccaucaugcgcuccgaggucgaguacggcaacugcaacacccgcugccagacccccaucggcgccaucaacuccuccaugcccuuccacaacauccacccccucaccaucggcgagugccccaaguacgucaaguccaacaagcucguccucgccaccggccuccgcaacuccccccagcgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcucaaggacaacgccaaggagcucggcaacggcugcuucgaguucuaccacaagugcaacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucguccucgccaucaugauggccggccucucccucuggaugugcuccaacggcucccuccagugccgcaucugcaucuga

SEQ ID NO: 105490 - RNA, 1695 nt, Artificial Sequence
  derived and/or modified sequence opt2 from hemagglutinin__InfluenzaA__ABF93441
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaagaacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagaucgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105491 - RNA, 1707 nt, Artificial Sequence
  derived and/or modified sequence opt2 from hemagglutinin__InfluenzaA__AGG12577
auggagaagaucguccuccucuucgccaucaucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucaucgacguccccgagugguccuacaucgucgagaaggccaaccccgccaacgaccucugcuaccccggcaacuucaacgacuacgaggagcucaagcaccuccucucccgcaucaaccacuucgagaagauccgcaucauccccaaggacuccuggcccgaccacgaggccucccucggcgucuccgccgccugcuccuaccagggcaacuccuccuucuuccgcaacgucgucuggcuccucaagaaggacaacgccuaccccaucaucaagaaguccuacaacaacaccaacaaggaggaccuccucguccucuggggcauccaccaccccaacgacgaggccgagcagacccgccucuaccagaaccccaccaccuacgucuccaucggcaccuccacccucaaccagcgccucgucccccgcaucgccacccgcuccaaggucaacggccaguccggccgcaucgacuucuucuggaccauccucaagcccaacgacgccaucaacuucgaguccaacggcaacuucaucgcccccgaguacgccuacaagaucgucaagaagggcgacuccaccaucaugcgcuccgaggucgaguacggcaacugcuccacccgcugccagacccccaugggcgccaucaacuccuccaugcccuuccacaacauccacccccucaccaucggcgagugccccaaguacgucaaguccaacaagcucguccucgccaccggccuccgcaacuccccccagaucgagcgccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucguccucgccaucauggucgccggccucucccucuggaugugcuccaacggcucccuccagugccgcaucugcaucuga

SEQ ID NO: 105492 - RNA, 1707 nt, Artificial Sequence; identical to SEQ ID NO: 105491
  derived and/or modified sequence opt2 from hemagglutinin__InfluenzaA__AGC13463

SEQ ID NO: 105493 - RNA, 1707 nt, Artificial Sequence; identical to SEQ ID NO: 97355
  derived and/or modified sequence opt2 from hemagglutinin__InfluenzaA__ACI06178/m1

SEQ ID NO: 105494 - RNA, 1707 nt, Artificial Sequence
  derived and/or modified sequence opt2 from hemagglutinin__InfluenzaA__AHF20402
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcguccgcccccucauccuccgcgacugcuccgucgccggcuggcuccucggcaaccccaugugcgacgaguucaucaacguccccgagugguccuacaucgucgagaaggccaaccccgucaacgaccucugcuaccccggcgucuucaacgacuacgaggagcucaagcaccuccucucccgcaucaaccacuucgagaagauccagaucauccccaagaacuccuggcccucccacgaggccucccucggcgucuccgccgccugccccuaccagggccaguccuccuucuuccgcaacgucgucuggcucaucaagaagaacaacaccuaccccaccaucaagcgcuccuacaacaacaccaaccaggaggaccuccucgucauguggggcauccaccaccccaacgacgccgucgagcagaccaagcucuaccagaaccccaccaccuacaucuccgucggcaccuccacccucaaccagcgccucaccccccgcaucgccacccgcuccaaggucaagggccucuccggccgcauggaguucuucuggaccauccucaagcccaacgacgccaucaacuucgaguccaacggcaacuucaucgcccccgaguacgccuacaagaucgucaagaagggcgacuccaccaucaugcgcuccgagcucgaguacggcaacugcaacaccaagugccagacccccaugggcgccaucaacuccuccaugcccuuccacaacauccacccccucaccaucggcgagugccccaaguacgucaaguccacccgccucguccucgccaccggccuccgcaacuccccccagcgcgaggagcgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacaagugcauggaguccguccgcaacggcaccuacgacuacccccaguacuccgaggaggcccgccucaagcgcgaggagaucuccggcgucaagcucgaguccaucggcgucuaccagauccucuccaucuacuccaccgucgccuccucccucgcccucgccaucauggucgccggccucucccucuggaugugcuccaacggcucccuccagugccgcaucugcaucuga

SEQ ID NO: 105495 - RNA, 1707 nt, Artificial Sequence
  derived and/or modified sequence opt2 from hemagglutinin__InfluenzaA__ABQ45850
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaagaacgacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105496 - RNA, 1713 nt, Artificial Sequence
  derived and/or modified sequence opt2 from hemagglutinin__InfluenzaA__AKI82373
auggagaagaucgucccccuccucgccaucaucggccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccucaaggacugcuccgucgccggcuggcuccucggcaaccccaugugcgacgaguuccucaacgucuccgagugguccuacaucgucgagaaggccucccccgccaacggccucugcuaccccggcgacuucaacgacuacgaggagcucaagcaccuccucaaccgcaucacccaccucaagaagaucaagaucauccccaaguccuacugguccaaccacgaggccuccuccggcgucuccgccgccugcuccuacaugggcgagcccuccuucuuccgcaacgucgucuggcucaucaagaagaacaacaccuacccccccaucaaggucaacuacaccaacaccaaccaggaggaccuccucguccucuggggcauccaccaccccaacaacgaggccgagcagauccagaucuaccagaaccucaucacccacaucuccgucggcaccuccacccucaaccagcgccucauccccaagaucgccacccgcuccaaggucaacggccaguccggccgcauggaguucuucuggaccauccucaagcccaacgacuccaucaacuucgacuccaacggcaacuucaucgcccccgaguacgccuacaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacgccccccagcgcgagcgcgagggcggccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcaucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgagaagguccgccuccagcuccgcgacaacgccaaggagcucggcaacggcugcuucgaguucuaccacaagugcgacaacgagugcauggaguccguccgcaacggcaccuacgacuacucccaguacuccgaggaggcccgccucucccgcgaggagaucaacggcgucaagcucgaguccauggucaccuaccagauccucuccaucuacuccaccgucgccuccucccucgcccucgccaucauggucgccggccucucccucuggaugugcuccaacggcucccuccagugccgcaucugcaucuga

SEQ ID NO: 105497 - RNA, 1713 nt, Artificial Sequence
  derived and/or modified sequence opt2 from hemagglutinin__InfluenzaA__EPI284473
auggagaagaucguccuccuccucgccaucaucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccucaaggacugcuccgucgccggcuggcuccucggcaaccccaugugcgacgaguuccucaacgucuccgagugguccuacaucgucgagaaggccucccccgccaacggccucugcuaccccggcgacuucaacgacuacgaggagcucaagcaccuccucaaccgcaucacccaccucaagaagaucaagaucauccccaaguccuacugguccaaccacgaggccuccuccggcgucuccgccgccugcuccuacaugggcgagcccuccuucuuccgcaacgucgucuggcucaucaagaagaacaacaccuacccccccaucaaggucaacuacaccaacaccaaccaggaggaccuccucguccucuggggcauccaccaccccaacaacgaggccgagcagauccagaucuaccagaaccucaucacccacaucuccgucggcaccuccacccucaaccagcgccucauccccaagaucgccacccgcuccaaggucaacggccaguccggccgcauggaguucuucuggaccauccucaagcccaacgacuccaucaacuucgacuccaacggcaacuucaucgcccccgaguacgccuacaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacgccccccagcgcgagcgcgagggcggccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcaucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgagaagguccgccuccagcuccgcgacaacgccaaggagcucggcaacggcugcuucgaguucuaccacaagugcgacaacgagugcauggaguccguccgcaacggcaccuacgacuacucccaguacuccgaggaggcccgccucucccgcgaggagaucaacggcgucaagcucgaguccauggucaccuaccagauccucuccaucuacuccaccgucgccuccucccucgcccucgccaucauggucgccggccucucccucuggaugugcuccaacggcucccuccagugccgcaucugcaucuga

SEQ ID NO: 105498 - RNA, 1710 nt, Artificial Sequence
  derived and/or modified sequence opt2 from hemagglutinin__InfluenzaA__ACO07033
auggagaagaucguccuccuccucgccaugaucggccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccucaaggacugcuccgucgccggcuggcuccucggcaaccccaugugcgacgaguuccucaacgucuccgagugguccuacaucgucgagaaggccucccccgccaacggccucugcuaccccggcgacuucaacgacuacgaggagcucaagcaccuccucucccgcaucaaccaccucaagaagaucaagaucauccccaaguccuacugguccaaccacgaggccuccuccggcgucuccgccgccugcuccuaccucggcgagcccuccuucuuccgcaacgucgucuggcucaucaagaagaacaacaccuacccccccaucaaggucaacuacaccaacaccaaccaggaggaccuccucguccucuggggcauccaccaccccaacgacgagaaggagcagauccgcaucuaccagaaccccaacaccuccaucuccgucggcaccuccacccucaaccagcgccucguccccaagaucgccacccgccccaaggucaacggccaguccggccgcauggaguucuucuggaccauccucaagcccaacgacuccaucaacuucgacuccaacggcaacuucaucgcccccgaguacgccuacaagaucgccaagaagggcgacuccgucaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacgccccccagcgcgagggcggccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcaucaccaacaaggucaacuccaucaucgacaagaugaacacccaguucgagaucgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgagaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucucccgcgaggagaucuccggcgucaagauggaguccauggucaccuaccagauccucuccaucuacuccaccgucgccuccucccucgcccucgccaucauggucgccggccucucccucuggaugugcuccaacggcucccuccagugccgcaucugcaucuga

SEQ ID NO: 105499 - RNA, 1695 nt, Artificial Sequence
  derived and/or modified sequence opt2 from hemagglutinin__InfluenzaA__EPI174803
auggagaagaucguccuccuccucgccaugaucggccucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccucaaggacugcuccgucgccggcuggcuccucggcaaccccaugugcgacgaguuccucaacgucuccgagugguccuacaucgucgagaaggccucccccgccaacggccucugcuaccccggcgacuucaacgacuacgaggagcucaagcaccuccucucccgcaucaaccaccucaagaagaucaagaucauccccaaguccuacugguccaaccacgaggccuccuccggcgucuccgccgccugcuccuaccucggcgagcccuccuucuuccgcaacgucgucuggcucaucaagaagaacaacaccuacccccccaucaaggucaacuacaccaacaccaaccaggaggaccuccucguccucuggggcauccaccaccccaacgacgagaaggagcagauccgcaucuaccagaaccccaacaccuccaucuccgucggcaccuccacccucaaccagcgccucguccccaagaucgccacccgccccaaggucaacggccaguccggccgcauggaguucuucuggaccauccucaagcccaacgacuccaucaacuucgacuccaacggcaacuucaucgcccccgaguacgccuacaagaucgccaagaagggcgacuccgucaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacgccccccagaccgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcaucaccaacaaggucaacuccaucaucgacaagaugaacacccaguucgagaucgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgagaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucucccgcgaggagaucuccggcgucaagauggaguccauggucaccuaccagauccucuccaucuacuccaccgucgccuccucccucgcccucgccaucauggucgccggccucucccucuggaugugcuccaacggcucccuccagugccgcaucugcaucuga

SEQ ID NO: 105500 - RNA, 1704 nt, Artificial Sequence
  derived and/or modified sequence opt2 from hemagglutinin__InfluenzaA__AGZ62382
auggagaagaucguccuccucuucgccgccaucucccucgucaaguccgaccacaucugcaucggcuaccacgccaacaacuccaccaagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucaucaacguccccgagugguccuacaucgucgagaaggccaaccccgccaacggccucugcuaccccggcaacuucaacgacuacgaggagcucaagcaccuccucucccgcaucaaccacuucgagaagauccgcaucauccccaaggacuccugguccgaccacgaggccucccucggcgucuccgccgccugccccuaccagggcaacuccuccuucuuccgcaacgucgucuggcucaucaagaaggacaacaccuaccccaccaucaagaaguccuacaacaacaccaaccaggaggaccuccucauccucuggggcauccaccaccccaacgacgaggccgagcagacccgccucuaccagaaccccaccaccuacaucuccaucggcaccuccacccucaaccagcgccucguccccaagaucgccacccgcuccaagaucaacggccaguccggccgcaucgacuucuucuggaccauccucaagcccaacgacgccauccacuucgaguccaacggcaacuucaucgcccccgaguacgccuacaagaucgucaagaagggcgacuccaccaucaugaaguccgaggucgaguacggcaacugcaacacccgcugccagacccccaucggcgccaucaacuccuccaugcccuuccacaacauccacccccucaccaucggcgagugccccaaguacgucaaguccaacaagcucguccucgccaccggccuccgcaacuccccccagcgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacguccgcaaccucuacgacaagguccgccuccagcucaaggacaacgccaaggagcucggcaacggcugcuucgaguucuaccacaagugcaacaacgagugcauggaguccguccgcaacggcaccuacgacuacccccaguacuccgaggaggcccgccuccgccgcgaggagaucuccggcgucaagcucgaguccaucggcaucuaccagauccucuccaucuacuccaccgucgccuccucccucguccucgccaucaugauggccggccucucccucuggaugugcuccaacggcucccuccagugccgcaucugcaucuga

SEQ ID NO: 105501 - RNA, 1704 nt, Artificial Sequence
  derived and/or modified sequence opt2 from hemagglutinin__InfluenzaA__ABG67978/m
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105502 - RNA, 1695 nt, Artificial Sequence
  derived and/or modified sequence opt2 from hemagglutinin__InfluenzaA__EPI827075
auggagaagaucguccuccucuucgccaccaucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaacccccucugcgacgaguucaccaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaggacuccugguccgaccacgaggccucccucggcgucuccgccgccugcuccuaccagggcaacuccuccuucuuccgcaacgucgucuggcucaucaagaaggacaacgccuaccccaccaucaagaagggcuacaacaacaccaaccgcgaggaccuccucauccucuggggcauccaccaccccaacgacgaggccgagcagacccgccucuaccagaaccccaccaccuacaucuccaucggcaccuccacccucaaccagcgccucguccccaagaucgccacccgcuccaagaucaacggccaguccggccgcaucgacuucuucuggaccauccucaagcccaacgacgccauccacuucgaguccaacggcaacuucaucgcccccgaguacgccuacaagaucgucaagaagggcgacuccaccaucaugcgcuccgaggucgaguacggcaacugcaacacccgcugccagacccccaucggcgccaucaacuccuccaugcccuuccacaacauccacccccucaccaucggcgagugccccaaguacgucaaguccaacaagcucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcucaaggacaacgccaaggagcucggcaacggcugcuucgaguucuaccacaagugcaacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucguccucgccaucaugauggccggccucucccucuggaugugcuccaacggcucccuccagugccgcaucugcaucuga

SEQ ID NO: 105503 - RNA, 1707 nt, Artificial Sequence
  derived and/or modified sequence opt2 from hemagglutinin__InfluenzaA__ABP96850
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcgacuucaacgacuacgaggagcucaagcaccuccucucccgcaucaaccacuucgagaagauccagaucauccccaaguccuccugguccgacuacgaggccuccuccggcgucuccuccgccugccccuaccagggccgcuccuccuucuuccgcaacgucgucuggcucaucaagaagaacaacgccuaccccaccaucaagcgcuccuacaacaacaccaaccaggaggaccuccucguccucuggggcauccaccaccccaacgacgccgccgagcagauccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucaacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucuuccucuggaugugcuccaacggcucccuccagugccgcaucugcaucuga

SEQ ID NO: 105504 - RNA, 1692 nt, Artificial Sequence
  derived and/or modified sequence opt2 from hemagglutinin__InfluenzaA__EPI827077
auggagaagaucguccuccuccucgccaucgucuccaucgucaaguccgaccagaucugcaucggcuaccacgccaacaacuccaccgagcaggucgacaccaucauggagaagaacgucaccgucacccacgcccaggacauccucgagaagacccacaacggcaagcucugcaaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaggacuccugguccgaccacgaggccuccggcgucuccuccgccugccccuaccagggccgcuccuccuucuuccgcaacgucgucuggcucaccaagaagaacgacgccuaccccaccaucaagaaguccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaaguccaacgacgccaucaacuucgaguccaacggcaacuucaucgcccccgagaacgccuacaagaucgucaagaagggcgacuccaccaucaugaaguccgagcucgaguacuccaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagcgcgagacccgcggccucuucggcgccaucgccggcuucaucgagggcggcuggcagggcauggucgacggcugguacggcuaccaccacuccaacgagcagggcuccggcuacgccgccgacaaggaguccacccagcgcgccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105505 - RNA, 1704 nt, Artificial Sequence
  derived and/or modified sequence opt2 from hemagglutinin__InfluenzaA__EPI594523
auggagaagaucauccuccuccucgccaucaucggccucgucaaguccgaccagaucugcgucggcuaccacgccaacaacuccaccgagcgcgucgacaccaucauggagaagaacgucaccgucacccacgcccaggacauccucgagaagacccacaacggcaagcucugcaaccucaacggcgucaagccccucauccucgaggacugcuccgucgccggcuggcuccucggcaaccccaugugcgacaaguuccucaacgucuccgagugguccuacaucgucgagaaggccggccccgccaacggccucugcuaccccggcgacuucaacgacuacgaggagcucaagcaccuccucucccgcaucaaccacuucgagaagaucgagaucauccccaagaaccacugguccaaccacaacaccuccggcgucuccuccgccugcuccuaccucgagaaccccuccuucuuccgcaacgucgucuggcucaccaagaagaacaacaccuaccccaccaucaaggucaacuacaccaacgccaaccagaaggaccuccucguccucuggggcauccaccaccccaacaacgaggccgagcagaagaugaucuaccagaacuccaacaccuacgucuccgucggcaccuccacccucaaccagcgccucguccccaagaucgccacccgcuccaaggucaacggccaguccggccgcaucgacuucuucuggaccauccucaagcccaacgacaccaucaacuucgacuccaacggcaacuucaucgcccccaaguacgccuacaagaucgucaagaagggcgacuccgccaucaugaaguccgagcucaaguacgacaacugcaacaccaagugccagacccccaucggcgccaucaacuccuccaugcccuuccacaacauccacccccucaccaucggcgagugccccaaguacgucaaguccaaccgccucguccucgccaccggccuccgcaacgccccccagaucgagggccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccgucgacggcaucaccaacaagaucaacuccaucaucgacaagaugaacaaccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgagaagguccgccuccagcuccgcgacaacgccaaggagcucggcaacggcugcuucgaguucuaccacaagugcgacaacgagugcauggaguccgucaagaacggcaccuacgacuacccccaguacuccgaggaggcccgccucaaccgcgaggagaucuccggcgucaagcucgaguccaccgucaccuaccagauccucuccaucuacuccaccgucgccuccucccucguccucgccaucauggucgccggccucucccucuggaugugcuccaacggcucccuccagugccgcaucugcaucuga

SEQ ID NO: 105506 - RNA, 1707 nt, Artificial Sequence
  derived and/or modified sequence opt2 from hemagglutinin__InfluenzaA__AAD37782
auggagcgcaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccuccgcgacugcuccgucgccggcuggcuccucggcaaccccaugugcgacgaguucaucaacguccccgagugguccuacaucgucgagaaggccucccccgccaacgaccucugcuaccccggcgacuucaacgacuacgaggagcucaagcaccuccucucccgcaccaaccacuucgagaagauccagaucaucccccccuccuccugguccaaccacgacgccuccuccggcgucuccuccgccugccccuaccacggccgcuccuccuucuuccgcaacgucgucuggcucaucaagaagaacuccgccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucguccccgagaucgccacccgccccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacaccccccagcgcgagcgccgccgcaagaagcgcggccucuucggcgccaucgccggcuucaucgagggcggcuggcagggcauggucaacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagcagauggaggacggcuuccucgacgucuggaccuacaacgccgagcuccucguccucauggagaacgagcgcacccucgacuuccacgacuccaacgucaagcaccucuacgacaagguccgccuccagcuccgcgacaacgccaaggagcucggcaacggcugcuucgaguucuaccacaagugcgacaacgagugcauggaguccgucaagaacggcaccuacgacuacccccaguacuccgaggaggcccgccucaaccgcgaggagaucuccggcgucaagcucgaguccaugggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105507 - RNA, 1707 nt, Artificial Sequence
  derived and/or modified sequence opt2 from hemagglutinin__InfluenzaA__AAD51927
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccuccgcgacugcuccgucgccggcuggcuccucggcaaccccaugugcgacgaguucaucaacguccccgagugguccuacaucgucgagaaggccucccccgccaacgaccucugcuaccccggcgacuucaacgacuacgaggagcucaagcaccuccucucccgcaccaaccacuucgagaagauccagaucauccccaaguccuccugguccaaccacgacgccuccuccggcgucuccuccgccugccccuaccacggccgcuccuccuucuuccgcaacgucgucuggcucaucaagaagaacuccgccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucguccccgagaucgccacccgccccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacaccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagcagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccgucaagaacggcaccuacgacuacccccaguacuccgaggaggcccgccucaaccgcgaggagaucuccggcgucaagcucgaguccaugggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105508 - RNA, 1704 nt, Artificial Sequence; identical to SEQ ID NO: 99229
  derived and/or modified sequence opt2 from hemagglutinin__InfluenzaA__AEO89181

SEQ ID NO: 105509 - RNA, 1707 nt, Artificial Sequence; identical to SEQ ID NO: 100683
  derived and/or modified sequence opt2 from hemagglutinin__InfluenzaA__AFM78567

SEQ ID NO: 105510 - RNA, 1707 nt, Artificial Sequence
  derived and/or modified sequence opt2 from hemagglutinin__InfluenzaA__ACR48872
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagaccaugcucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugauggccggccucucccucuggaugugcuccaacggcucccuccagugccgcaucugcaucuga

SEQ ID NO: 105511 - RNA, 1707 nt, Artificial Sequence; identical to SEQ ID NO: 100683
  derived and/or modified sequence opt2 from hemagglutinin__InfluenzaA__ABW06108

SEQ ID NO: 105512 - RNA, 1707 nt, Artificial Sequence
  derived and/or modified sequence opt2 from hemagglutinin__InfluenzaA__EPI341633
auggagaagaucacccuccuccucuccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccucaaggacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaagaccuacaacaacaccaaccaggaggaccuccucauccucuggggcauccaccaccccaacaacggcgccgagcagaccaugcucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccaccccaucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucuccaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugaucgccggccucucccucuggaugugcuccaacggcucccuccagugccgcaucugcaucuga

SEQ ID NO: 105513 - RNA, 1707 nt, Artificial Sequence
  derived and/or modified sequence opt2 from hemagglutinin__InfluenzaA__ABD95991
auggagaagaucaugcuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105514 - RNA, 1707 nt, Artificial Sequence
  derived and/or modified sequence opt2 from hemagglutinin__InfluenzaA__AGN69453
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccgccggcgucuccuccgccugccccuaccagggcauguccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagaccaagcucuaccagaacuccaccaccuacaucuccgucggcaccuccacccucaaccagcgccucguccccaagaucgccacccgcuccaaggucaacggccaguccggccgcaucgaguucuucuggaccauccucaagcccaacgacaccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccucccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105515 - RNA, 1707 nt, Artificial Sequence
  derived and/or modified sequence opt2 from hemagglutinin__InfluenzaA__AGN69452
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccgccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaacuccaccaccuacaucuccgucggcaccuccacccucaaccagcgccucguccccaagaucgccacccgcuccaaggucaacggccaguccggccgcaucgaguucuucuggaccauccucaagcccaacgacaccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccucccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105516 - RNA, 1707 nt, Artificial Sequence
  derived and/or modified sequence opt2 from hemagglutinin__InfluenzaA__ABD73284
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccgccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccucccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105517 - RNA, 1695 nt, Artificial Sequence
  derived and/or modified sequence opt2 from hemagglutinin__InfluenzaA__ABF93440
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaagaucaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaaggacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgagaacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagaucgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105518 - RNA, 1701 nt, Artificial Sequence
  derived and/or modified sequence opt2 from hemagglutinin__InfluenzaA__AKC45369
auggagaagaucguccuccuccucgccgucgucucccucgucaaguccgaccagaucugcaucggcuaccacgccaacaacuccaccgagcaggucgacaccaucauggagaagaacgucaccgucacccacgcccaggacauccucgagaagacccacaacggccgccucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagacccucaucauccccaaguccuccuggcccaaccacaccuccuccggcgucuccgccgccugccccuaccagggcacccccuccuucuuccgcaacgucgucuggcucaccaagaagaacgacgccuaccccaccaucaagauguccuacaacaacaccaaccgcgaggaccuccucauccucuggggcauccaccacuccaacaacgccgccgagcagaccaaccucuacaagaaccccaccaccuacgucuccgucggcaccuccacccucaaccagcgccucguccccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgaccgcgaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 105519 - RNA, 1704 nt, Artificial Sequence; identical to SEQ ID NO: 104470
  derived and/or modified sequence opt2 from hemagglutinin__InfluenzaA__AJS18479

SEQ ID NO: 105520 - RNA, 1704 nt, Artificial Sequence
  derived and/or modified sequence opt2 from hemagglutinin__InfluenzaA__EPI691378
auggagaagaucguccuccuccucgccgucgucucccucgucaaguccgaccagaucugcaucggcuaccacgccaacaacuccaccgagcaggucgacaccaucauggagaagaacgucaccgucacccacgcccaggacauccucgagaagacccacaacggccgccucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagacccucaucauccccaaguccuccuggcccaaccacgagaccucccucggcgucuccgccgccugccccuaccagggcguccccuccuucuuccgcaacgucgucuggcucaccaagaagaacgacgccuaccccaccaucaagauguccuacaacaacaccaaccgcgaggaccuccucauccucuggggcauccaccacuccaacaacgccgccgagcagaccaaccucuacaagaaccccaccaccuacgucuccgucggcaccuccacccucaaccagcgccucguccccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgaccgcgaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 105521 - RNA, 1704 nt, Artificial Sequence
  derived and/or modified sequence opt2 from hemagglutinin__InfluenzaA__EPI533583
auggagaagaucguccuccuccucgccaucgucucccucgucaagggcgaccagaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagauccucaucauccccaaguccuccuggaccaaccacgagaccucccucggcgucuccgccgccugccccuaccagggcacccccuccuucuuccgcaacgucgucuggcucaucaagaagaacgacgccuaccccaccaucaagaucuccuacaacaacaccaaccaggaggaccuccucauccucuggggcguccaccacuccaacaacgccgccgagcagaccaaccucuacaagaaccccaccaccuacaucuccgucggcaccuccacccucaaccagcgccucguccccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagaagcgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacaagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 105522 - RNA, 1701 nt, Artificial Sequence; identical to SEQ ID NO: 104483
  derived and/or modified sequence opt2 from hemagglutinin__InfluenzaA__AKS48023

SEQ ID NO: 105523 - RNA, 1701 nt, Artificial Sequence
  derived and/or modified sequence opt2 from hemagglutinin__InfluenzaA__EPI587621
auggagaagaugguccuccuccucgccgccgucucccucgucaaguccgaccagaucugcaucggcuaccacgccaacaacuccaccgagcaggucgacaccaucauggagaagaacgucaccgucacccacgcccaggacauccucgagaagacccacaacggccgccucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagacccucaucauccccaaguccuccuggcccaaccacaccuccuccggcgucuccgccgccugccccuaccagggcaugcccuccuucuuccgcaacgucgucuggcucaccaagaagaacgacgccuaccccaccaucaagauguccuacaacaacaccuaccgcgaggaccuccucauccucuggggcauccaccacuccaacaacgccgccgagcagaccaaccucuacaagaaccccaccaccuacgucuccgucggcaccuccacccucaaccagcgccucgagcccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgaccgcgaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 105524 - RNA, 1704 nt, Artificial Sequence
  derived and/or modified sequence opt2 from hemagglutinin__InfluenzaA__AJE30333
auggagaagaucguccuccuccucgccgucaucucccucgucaaguccgaccagaucugcaucggcuaccacgccaacaacuccaccaagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcacccucaacgacuacgaggagcucaagcaccuccucucccgcaucaaccacuucgagaagacccucaucaucccccgcuccuccuggcccaaccacgagaccucccucggcgucuccgccgccugccccuaccagggcgccuccuccuucuuccgcaacgucgucuggcucaucaagaagaacgacgccuaccccaccaucaagaucuccuacaacaacaccaaccgcgaggaccuccucauccucuggggcauccaccacuccaacaacgccgccgagcagaccaaccucuacaagaaccccgacaccuacgucuccgucggcaccuccacccucaaccagcgccucguccccaagaucgccacccgcucccaggucaacggccaguccggccgcauggacuucuucuggaccauccucaagcccaacgacgccauccacuucgaguccaacggcaacuucaucgcccccgaguacgccuacaagaucgucaagaagggcgacuccaccaucaugaaguccgagauggaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuaccccaaguacuccgaggaggccauccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 105525 - RNA, 1704 nt, Artificial Sequence
  derived and/or modified sequence opt2 from hemagglutinin__InfluenzaA__EPI459855
augaucgccaucgucgucaucgccauccucgccuccgccggcaaguccgacaagaucugcaucggcuaccacgccaacaacuccaccacccaggucgacacccuccucgagaagaacgucaccgucacccacuccgucgagcuccucgagaaccagaaggagaagcgcuucugcaagaucaugaacaaggccccccucgaccucaaggacugcaccaucgagggcuggauccucggcaaccccaagugcgaccuccuccucggcgaccaguccugguccuacaucgucgagcgccccaacgcccagaacggcaucugcuaccccggcguccucaacgagcucgaggagcucaaggccuucaucggcuccggcgagcgcgucgagcgcuucgagauguuccccaaguccaccugggccggcgucgacaccucccgcggcgucaccaacgccugccccuccuacaccaucgacuccuccuucuaccgcaaccucgucuggaucgucaagaccgacuccgccaccuaccccgucaucaagggcaccuacaacaacaccggcacccagcccauccucuacuucuggggcguccaccacccccucgacaccaccguccaggacaaccucuacggcuccggcgacaaguacguccgcaugggcaccgaguccaugaacuucgccaagucccccgagaucgccgcccgccccgccgucaacggccagcgcucccgcaucgacuacuacugguccguccuccgccccggcgagacccucaacgucgaguccaacggcaaccucaucgcccccugguacgccuacaaguucgucuccaccaacaagaagggcgccgucuucaaguccgaccuccccaucgagaacugcgacgccaccugccagaccaucaccggcguccuccgcaccaacaagaccuuccagaacgucuccccccucuggaucggcgagugccccaaguacgucaaguccgagucccuccgccucgccaccggccuccgcaacgucccccagaucgccacccgcggcaucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucaacaagaugaacacccaguucgaggccgucgaccacgaguucuccaaccucgagcgccgcaucggcaaccucaacaagcgcauggaggacggcuuccucgacgucuggaccuacaacgccgagcuccucguccuccucgagaacgagcgcacccucgaccuccacgacgccaacgucaagaaccucuacgagaaggucaagucccagcuccgcgacaacgccaacgaccucggcaacggcugcuucgaguucuggcacaagugcgacaacgagugcauggaguccgucaagaacggcaccuacgacuaccccaaguaccagaaggaguccaagcucaaccgccagggcaucgaguccgucaagcucgagaaccucggcgucuaccagauccucgccaucuacuccaccgucuccuccucccucguccucgucggccucaucauggccaucggccucuggaugugcuccaacggcuccaugcagugccgcaucugcaucuga

SEQ ID NO: 105526 - RNA, 1704 nt, Artificial Sequence; identical to SEQ ID NO: 105525
  derived and/or modified sequence opt2 from hemagglutinin__InfluenzaA__EPI459855/m1

SEQ ID NO: 105527 - RNA, 1692 nt, Artificial Sequence
  derived and/or modified sequence opt2 from hemagglutinin__InfluenzaA__ACZ36872
augaacacccagauccucgucuucgcccucgucgccgucauccacaccaacgccgacaagaucugccucggccaccacgccgucuccaacggcaccaaggucaacacccucaccgagcgcggcgucgaggucgucaacgccaccgagaccgucgagcgcaccaacauccccaagaucugcuccaagggcaagcgcaccgucgaccucggccagugcggccuccucggcaccaucaccggccccccccagugcgaccaguuccucgaguucuccgccgaccucaucaucgagcgccgcgacggcaacgacgucugcuaccccggcaaguucgucaacggcgaggcccuccgccagauccuccgcaaguccggcggcaucaacaaggagaccaugggcuucaccuacuccggcauccgcaccaacggcaccaccuccgccugccgccgcuccggcuccuccuucuacgccgagaugaaguggcuccucuccgacaccgacaacgccgccuucccccagaugaccaaguccuacaagaacacccgccgcgagcccgcccucaucgucuggggcauccaccacuccggcuccaccaccgagcagaccaagcucuacggcuccggcaacaagcucgucaccgucggcuccuccaaguaccagcaguccuucguccccucccccggcacccgcccccaggucaacggccaguccggccgcaucgacuuccacuggcucauccucgacuccaacgacaccgucaccuucuccuucaacggcgccuucaucgcccccgaccgcgccuccuuccucaagggcaaguccaugggcauccaguccgacguccaggucgacgccaacugcgagggcgagugcuaccacuccggcggcaccaucaccuccucccuccccuuccagaacaucaacucccgcgccgucggcaagugcccccgcuacgucaagcaggagucccuccuccucgccaccggcaugaagaacguccccgagcuccccaagaagcgccgcaagcgcggccucuucggcgccaucgccggcuucaucgagaacggcugggagggccucgucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcguccgcaagcagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccggcggcuacaaggacgucauccucugguucuccuucggcgccuccugcuuccuccuccucgccaucgccaugggccucgucuucaucugcgucaagaacggcaacaugcgcugcaccaucugcaucuga

SEQ ID NO: 105528 - RNA, 1692 nt, Artificial Sequence
  derived and/or modified sequence opt2 from hemagglutinin__InfluenzaA__AGB51388
augaacacccagauccucgucuucgcccucgucgccgucauccacaccaacgccgacaagaucugccucggccaccacgccgucuccaacggcaccaaggucaacacccucaccgagcgcggcgucgaggucgucaacgccaccgagaccgucgagcgcaccaacauccccaagaucugcuccaagggcaagcgcaccgucgaccucggccagugcggccuccucggcaccaucaccggccccccccagugcgaccaguuccucgaguucuccgccgaccucaucaucgagcgccgcgacggcaacgacgucugcuaccccggcaaguucgucaacggcgaggcccuccgccagauccuccgcaaguccggcggcaucaacaaggagaccaugggcuucaccuacuccggcauccgcaccaacggcaccaccuccgccugccgccgcuccggcuccuccuucuacgccgagaugaaguggcuccucuccgacaccgacaacgccgccuucccccagaugaccaaguccuacaagaacacccgccgcgagcccgcccucaucgucuggggcauccaccacuccggcuccaccaccgagcagaccaagcucuacggcuccggcaacaagcucgucaccgucggcuccuccaaguaccagcaguccuucguccccaaccccgagacccgcccccaggucaacggccaguccggccgcaucgacuuccacuggcucauccucgacuccaacgacaccgucaccuucuccuucaacggcgccuucaucgcccccgaccgcgccuccuuccucaagggcaaguccaugggcauccaguccgacguccaggucgacgccaacugcgagggcgagugcuaccacuccggcggcaccaucaccuccucccuccccuuccagaacaucaacucccgcgccgucggcaagugcccccgcuacgucaagcaggagucccuccuccucgccaccggcaugaagaacguccccgagcuccccaagaagcgccgcaagcgcggccucuucggcgccaucgccggcuucaucgagaacggcugggagggccucgucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaccggcaacgucaucaacuggacccgcgacuccaucaccgaggucugguccuacaacgccgagcuccucgucgccauggagaaccagcacaccaucgaccucgccgacuccgagaugaacaagcucuacgagcgcguccgcaagcagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccggcggcuacaaggacgucauccucugguucuccuucggcgccuccugcuuccuccuccucgccaucgccaugggccucgucuucaucugcgucaagaacggcaacaugcgcugcaccaucugcaucuga

SEQ ID NO: 105529 - RNA, 1683 nt, Artificial Sequence; identical to SEQ ID NO: 101500
  derived and/or modified sequence opt2 from hemagglutinin__InfluenzaA__EPI439507

SEQ ID NO: 105530 - RNA, 1704 nt, Artificial Sequence
  derived and/or modified sequence opt2 from hemagglutinin__InfluenzaA__EPI164216
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucgucaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105531 - RNA, 1683 nt, Artificial Sequence; identical to SEQ ID NO: 103863
  derived and/or modified sequence opt2 from hemagglutinin__InfluenzaA__EPI486492

SEQ ID NO: 105532 - RNA, 1683 nt, Artificial Sequence
  derived and/or modified sequence opt2 from hemagglutinin__InfluenzaA__EPI740738
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgucaccuccgccugcaagcgcuccggcuccuccuucuacgccgagaugaaguggcuccucuccaacaccgacaacgccgccuucccccagaugaccaaguccuacaagaacacccgcaagucccccgccaucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucauccucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgccaagaccaaccagcaguucgagcucaucgacaacgaguucaacgaggucgagaagcagaucggcaacgucaucaacuggacccgcgacuccaucaccgaggucugguccuacaacgccgagcuccucaucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccaccgcaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 105533 - RNA, 1683 nt, Artificial Sequence
  derived and/or modified sequence opt2 from hemagglutinin__InfluenzaA__EPI730495
augaacauccagauccucgucuucgcccucaucgccaucauccccaccgacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcaaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgccaucaucgucuggggcauccaccacuccgucuccaccgccgagcagaccaagcucuacggcuccggcuccaagcucgucaccgucggcuccuccaacuaccagcaguccuucguccccucccccggcgcccgcccccaggucaacggccucuccggccgcaucgacuuccacuggcucauccucaaccccaacgacaccgucaccuucuccuucaacggcgccuucaucgcccccgaccgcgccuccuuccuccgcggcaaguccaugggcauccaguccggcguccaggucgacgccgacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaucgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccccgccaucgucaugggccucgucuucaugugcgucaagaacggcaacaugcgcugcaccaucugcaucuga

SEQ ID NO: 105534 - RNA, 1683 nt, Artificial Sequence
  derived and/or modified sequence opt2 from hemagglutinin__InfluenzaA__EPI712926
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacaacggcauccgcaucaacggcgucaccuccgccugcaagcgcuccggcuccuccuucuacgccgagaugaaguggcuccucuccaacaccgacaacgccgccuucccccagaugaccaaguccuacaagaacacccgcaagucccccgccaucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucauccucaaccccaacgacaccgucaccuucuccuucaacggcgccuucaucgcccccgaccgcgccuccuuccuccgcggcaaguccaucggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgccaagaccaaccagcaguucgagcucaucgacaacgaguucaacgaggucgagaagcagaucggcaacgucaucaacuggacccgcgacuccaucaccgaggucugguccuacaacgccgagcuccucaucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccaccgcaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 105535 - RNA, 1683 nt, Artificial Sequence; identical to SEQ ID NO: 101500
  derived and/or modified sequence opt2 from hemagglutinin__InfluenzaA__AGL44438

SEQ ID NO: 105536 - RNA, 1683 nt, Artificial Sequence
  derived and/or modified sequence opt2 from hemagglutinin__InfluenzaA__EPI445996
auggagaccgucucccucaugaccauccuccuccucgucaccaccuccaacgccgacaagaucugcaucggccaccaguccaccaacuccaccgagaccgucgacacccucaccgagaccaacguccccgucacccacgccaaggagcuccuccacaccgaccacaacggcaugcucugcgccaccaaccucggccacccccucauccucgacaccugcaacgucgagggccucaucuacggcaaccccuccugcgaccuccuccucggcggccgcgagugguccuacaucgucgagcgccccuccgccgucaacggcaccugcuaccccggcaacgucgagaaccucgaggagcuccgcacccucuucuccuccuccuccuccuaccagcgcauccagaucuuccccgacaccaucuggaacgucaccuacaccggcaccuccaaguccugcuccgacuccuucuaccgcaacaugcgcuggcucacccagaagaacggccucuaccccguccaggacgcccaguucaccaacaaccgcggcaaggacauccucuucgucuggggcauccaccacccccccaccgacaccgcccagaccaaccucuacacccgcaccgacaccaccaccuccgucaccaccgagaaccucgaccgcaccuucaagccccucaucggcccccgcccccucgucaacggccucaucggccgcaucaacuacuacugguccguccucaagcccggccagacccuccgcguccgcuccaacggcaaccucaucgcccccugguacggccacguccucuccggcgagucccacggccgcauccucaagaccaaccucaacuccggcaacugcgucguccagugccagaccgagaagggcggccucaacuccacccuccccuuccacaacaucuccaaguacgccuucggcaacugccccaaguacaucggcgucaagucccucaagcucgccaucggccuccgcaacguccccgccaaguccucccgcggccucuucggcgccaucgccggcuucaucgagggcggcuggcccggccucgucgccggcugguacggcuuccagcacuccaacgaccagggcgucggcaucgccgccgaccgcgucuccacccagaaggccgucgacaagaucaccuccaaggucaacaacaucgucgacaagaugaacaagcaguacgagaucaucgaccacgaguucuccgaggucgagacccgccucaacaugaucaacaacaagaucgacgaccagauccaggacgucugggccuacaacgccgagcuccucguccuccucgagaaccagaagacccucgacgagcacgacgccaacgucaacaaccucuacaacaaggucaagcgcgcccucggcuccaacgcccucgaggacggcaagggcugcuucgagcucuaccacaagugcgacgaccagugcauggagaccauccgcaacggcaccuacaaccgccgcaaguaccaggaggagucccgccucgagcgccagaagaucgagggcaucaagcucgaguccgagggcaccuacaagauccucaccaucuacuccaccgucgccuccucccucguccucgccaugggcuucgccgccuuccucuucugggccauguccaacggcuccugccgcugcaacaucugcaucuga

SEQ ID NO: 105537 - RNA, 1695 nt, Artificial Sequence
  derived and/or modified sequence opt2 from hemagglutinin__InfluenzaA__EPI433309
auggagaagaucguccuccuccucgccaucgccucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacaaguucaacgacguccccgagugguccuacaucgucgagaaggccaaccccgccaacgaccucugcuaccccggcaaccucaacgacuacgaggagcucaagcaccuccucucccgcaucaaccacuucgagaagauccagaccuuccccaaguccuccugguccgaccacgaggccucccucggcgucuccgccgccugccccuaccagggcaugcccuccuucuuccgcaacgucgucuggcucaucaagaagaacaacaccuaccccaccaucaaguccuccuacaacaacaccaaccaggaggaccuccucauccucuggggcauccaccacuccaacgacgaggccgagcagacccgccucuaccagaacuccaacaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucggcuacggcgacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccagaucgagacccgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucgagcgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 105538 - RNA, 1683 nt, Artificial Sequence
  derived and/or modified sequence opt2 from hemagglutinin__InfluenzaA__EPI470859
auggaggccaucccccucaucaccauccuccucgucgucaccgccuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccuccuccucggcggccgcgagugguccuacaucgucgagcgccccuccgccgucaacggcaugugcuaccccggcaacgucgagaaccucgaggagcuccgcuccuucuucuccuccgccuccuccuaccagcgcauccagaucuuccccgacaccaucuggaacgucuccuacuccggcaccuccaaggccugcuccgacuccuucuaccgcuccaugcgcuggcucacccagaagaacaacgccuaccccauccaggacgcccaguacaccaacaaccgcggcaaguccauccucuucauguggggcaucaaccacccccccaccgacaccgcccagaccaaccucuacacccgcaccgacaccaccaccuccgucgccaccgaggacaucaaccgcaccuucaagcccgucaucggcccccgcccccucgucaacggccuccagggccgcaucgacuacuacugguccguccucaagcccggccagacccuccgcguccgcuccaacggcaaccucaucgcccccugguacggccacauccucuccggcgagucccacggccgcauccucaagaccgaccucaacuccggcuccugcgucguccagugccagaccgagcgcggcggccucaacaccacccuccccuuccacaacgucuccaaguacgccuucggcaacugccccaaguacgucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcgucggcaucgccgccgaccgcgacuccacccagcgcgccaucgacaagaucaccuccaaggucaacaacaucgucgacaagaugaacaagcaguacgagaucaucgaccacgaguucuccgaggucgagaaccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 105539 - RNA, 1683 nt, Artificial Sequence
  derived and/or modified sequence opt2 from hemagglutinin__InfluenzaA__EPI498037
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacaacggcaccuccaaggccugcuccggcuccuucuaccgcuccaugcgcuggcucacccgcaagaacggcgacuaccccauccaggacguccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacaaccagugcauggagaccauccgcaacggcaccuacaacaagcgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 105540 - RNA, 1683 nt, Artificial Sequence
  derived and/or modified sequence opt2 from hemagglutinin__InfluenzaA__AGO17847
auggagaccaucucccucaugaccauccuccucaucaccaccgccuccaacgccgacaagaucugcaucggccaccaguccaccaacuccaccgagaccgucgacacccucaccgagaccaacguccccgucacccacgccaaggagcuccuccagaccgagcacaacggcaugcucugcgccaccaaccucggccacccccucauccucgacaccugcaccaucgagggccucaucuacggcaaccccuccugcgaccuccuccucgagggccgcgagugguccuacaucgucgagcgccccuccgccgucaacggcaccugcuaccccggcaacgucgagaaccucgaggagcuccgcacccucuucuccuccgccuccuccuaccagcgcauccagaucuuccccgacaccaccuggaacgucaccuacaccggcaccucccgcuccugcuccggcuccuucuaccgcuccaugcgcuggcucacccagaaguccggcuucuaccccguccaggacgccaaguacaccaacaaccgcggcaagaacauccucuucgucuggggcauccaccacccccacaccuacaccgaccagaccacccucuacauccgcaacgacaccaccaccuccgucaccaccgaggagcucaaccgcaucuucaagcccgucaucgucccccgccuccucgucaacggccagcagggccgcaucgacuacuacugguccguccucaagcccggccagacccuccgcguccgcuccaacggcaaccucaucgcccccugguacggccacguccucuccggcggcucccacggccgcauccucaagaccgaccucaaguccggcaacugcgucguccagugccagaccgagaagggcggccucaacuccacccuccccuuccacaacaucuccaaguacgccuucggcaccugccccaaguacgucaaggucaacucccucaagcucgccaucggccuccgcaacguccccgcccgcuccaaccgcggccucuucggcgccaucgccggcuucaucgagggcggcuggcccggccucgucgccggcugguacggcuuccagcacuccaacgaccagggcgucggcauggccgccgaccgcgacuccacccagaaggccgucgacaagaucaccuccaaggucaacaacaucgucgacaagaugaacaagcaguacgagaucaucgaccacgaguucuccgaggucgagacccgccucaacaugaucaacaacaagaucgacgaccagauccaggacgucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacgaccgccgcaaguaccgcgaggagucccgccucgagcgccagcgcaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 105541 - RNA, 1683 nt, Artificial Sequence
  derived and/or modified sequence opt2 from hemagglutinin__InfluenzaA__ANZ03807
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccucucccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacgacggcaccuccaccgccugcuccggcuccuucuaccgcuccaugcgcuggcucacccgcaagaacggcgacuaccccacccaggacgcccaguacaccaacaaccagggcaagaacauccucuucauguggggcaucaaccacccccccaccgacgacacccagcgcaaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcaacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 105542 - RNA, 1683 nt, Artificial Sequence; identical to SEQ ID NO: 105541
  derived and/or modified sequence opt2 from hemagglutinin__InfluenzaA__EPI680526

SEQ ID NO: 105543 - RNA, 1683 nt, Artificial Sequence; identical to SEQ ID NO: 105197
  derived and/or modified sequence opt2 from hemagglutinin__InfluenzaA__ALT20080

SEQ ID NO: 105544 - RNA, 1410 nt, Artificial Sequence
  derived and/or modified sequence opt2 from neuraminidase__InfluenzaA__AAA43084
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccggcuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggagucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 105545 - RNA, 1362 nt, Artificial Sequence
  derived and/or modified sequence opt2 from neuraminidase__InfluenzaA__AAA43397
augaaccccaaccagaagaucaucaccaucggcuccaucugcauggucgucggcaucaucucccucauccuccagaucggcaacaucaucuccaucuggaucucccacuccauccagaccggcaaccagaaccacaccggcaucugcaaccagggcuccaucaccuacaaggucgucgccggccaggacuccaccuccgucauccucaccggcaacuccucccucugccccauccgcggcugggccauccacuccaaggacaacggcauccgcaucggcuccaagggcgacgucuucgucauccgcgagcccuucaucuccugcucccaccucgagugccgcaccuucuuccucacccagggcgcccuccucaacgacaagcacucccgcggcaccuucaaggaccgcucccccuaccgcgcccucauguccugccccgucggcgaggcccccucccccuacaacucccgcuucgaguccgucgccugguccgccuccgccugccacgacggcgucggcuggcucaccaucggcaucuccggccccgacgacggcgccgucgccguccucaaguacaaccgcaucaucaccgagaccaucaaguccuggcgcaagaacauccuccgcacccaggaguccgagugcaccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuacaagaucggcuacaucugcuccggcgucuucggcgacaacccccgccccaaggacggcaccggcuccugcggccccgucuccgccgacggcgccaacggcgucaagggcuucuccuacaaguacggcaacggcgucuggaucggccgcaccaaguccgacuccucccgccacggcuucgagaugaucugggaccccaacggcuggaccgagaccgacucccgcuucuccaugcgccaggacgucgucgccaucaccaaccgcuccggcuacuccggcuccuucguccagcaccccgagcucaccggccucgacugcaugcgccccugcuucugggucgagcucauccgcggccuccccgaggaggacgccaucuggaccuccggcuccaucaucuccuucugcggcgucaacuccgacaccgucgacugguccuggcccgacggcgccgagcuccccuucaccaucgacaaguga

SEQ ID NO: 105546 - RNA, 1365 nt, Artificial Sequence
  derived and/or modified sequence opt2 from neuraminidase__InfluenzaA__AAA43412
augaaccccaaccagaagaucaucaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccugggucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgaccgccacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcauccgccccugcuucugggucgagcucauccgcggccgccccaaggagaagaccaucuggaccuccgccuccuccaucuccuucugcggcgucaacuccgacaccgucgacugguccuggcccgacggcgccgagcuccccuucaccaucgacaaguga

SEQ ID NO: 105547 - RNA, 1410 nt, Artificial Sequence
  derived and/or modified sequence opt2 from neuraminidase__InfluenzaA__AAG01743
augaaccccaaccagaagaucaucacccucggcuccgucucccucaccaucgccaccaucugcuuccucaugcagaucgccauccucgucaccaccgucacccuccacuucaagcaguacgagugcgacuaccccgccaacaaccaggccaugcccugcgagcccaucaucaucgagcgcaacaucaccgagaucgucuaccucaccaacaccaccaucgagaaggaggucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaccuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucaacuccuccuacgucugcuccggccucgucggcgacaccccccgcaacaacgaccgcuccuccuccuccuacugccagaaccccaacaacgagaagggcacccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaacaucaugcccaucuga

SEQ ID NO: 105548 - RNA, 1410 nt, Artificial Sequence
  derived and/or modified sequence opt2 from neuraminidase__InfluenzaA__AAG01759
augaaccccaaccagaagaucaucaccaucggcuccgucucccucaccaucgccaccaugugcuuccucaugcagaucgccauccucgucaccaccgucacccuccacuucaagcaguacgagugcaacuccccccccaacaaccaggucauccucugcgagcccaccaucaucgagcgcaacaucaccgagaucgucuaccucaccaacaccaccaucgagaaggagaucugccccaagcucgccgaguacaagaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccaacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105549 - RNA, 1410 nt, Artificial Sequence
  derived and/or modified sequence opt2 from neuraminidase__InfluenzaA__AAG01777
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucauccucugcgagcccaccaucaucgagcgcaacaucaccgagaucgucuaccucaccaacaccaccaucgagaaggagaucugccccaagcucgccgaguacaagaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccaacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccccgucaucgucgaccgcggcgaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105550 - RNA, 1410 nt, Artificial Sequence
  derived and/or modified sequence opt2 from neuraminidase__InfluenzaA__AAG01786
augaaccccaaccagaagaucaucaccaucggcuccgucucccucaccaucgccaccaugugcuuccucaugcagaucgccauccucgucaccaccgucacccuccacuucaagcaguacgagugcaacuccccccccaacaaccaggucauccucugcgagcccaccaucaucgagcgcaacaucaccgagaucgucuaccucaccaacaccaccaucgagaaggagaucugccccaagcucgccgaguacaagaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccaacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcgaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105551 - RNA, 1410 nt, Artificial Sequence
  derived and/or modified sequence opt2 from neuraminidase__InfluenzaA__AAK71688
augaaccccaaccagaagaucaucaccaucggcuccgucucccucaccaucgccaccaugugcuuccucaugcagaucgccauccucgucaccaccgucacccuccacuucaagcaguacgagugcaacuccccccccaacaaccaggucauccucugcgagcccaccaucaucgagcgcaacaucaccgagaucgucuaccucaccaacgccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccaacugccucaaccccaacaacgaggagggcggccacggcgucaagggcugggccuucgacgacggcaacgacgucuggaugggccgcaccaucuccgaggagcuccgcuccggcuacgagaccuucaaggucaucgagggcugguccaagcccaacuccaagcuccagaucaaccgccaggucaucgucgaccgcggcgaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105552 - RNA, 1410 nt, Artificial Sequence
  derived and/or modified sequence opt2 from neuraminidase__InfluenzaA__AAN01169
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105553 - RNA, 1410 nt, Artificial Sequence; identical to SEQ ID NO: 105552
  derived and/or modified sequence opt2 from neuraminidase__InfluenzaA__AAN01170

SEQ ID NO: 105554 - RNA, 1410 nt, Artificial Sequence
  derived and/or modified sequence opt2 from neuraminidase__InfluenzaA__AAN01171
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105555 - RNA, 1410 nt, Artificial Sequence; identical to SEQ ID NO: 105552
  derived and/or modified sequence opt2 from neuraminidase__InfluenzaA__AAN01172

SEQ ID NO: 105556 - RNA, 1410 nt, Artificial Sequence
  derived and/or modified sequence opt2 from neuraminidase__InfluenzaA__AAN01173
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105557 - RNA, 1410 nt, Artificial Sequence; identical to SEQ ID NO: 105552
  derived and/or modified sequence opt2 from neuraminidase__InfluenzaA__AAN01174

SEQ ID NO: 105558 - RNA, 1410 nt, Artificial Sequence; identical to SEQ ID NO: 105552
  derived and/or modified sequence opt2 from neuraminidase__InfluenzaA__AAN01175

SEQ ID NO: 105559 - RNA, 1410 nt, Artificial Sequence; identical to SEQ ID NO: 105552
  derived and/or modified sequence opt2 from neuraminidase__InfluenzaA__AAN01176

SEQ ID NO: 105560 - RNA, 1410 nt, Artificial Sequence; identical to SEQ ID NO: 105552
  derived and/or modified sequence opt2 from neuraminidase__InfluenzaA__AAN01177

SEQ ID NO: 105561 - RNA, 1410 nt, Artificial Sequence; identical to SEQ ID NO: 105552
  derived and/or modified sequence opt2 from neuraminidase__InfluenzaA__AAN01178

SEQ ID NO: 105562 - RNA, 1410 nt, Artificial Sequence; identical to SEQ ID NO: 105552
  derived and/or modified sequence opt2 from neuraminidase__InfluenzaA__AAN01179

SEQ ID NO: 105563 - RNA, 1410 nt, Artificial Sequence; identical to SEQ ID NO: 105552
  derived and/or modified sequence opt2 from neuraminidase__InfluenzaA__AAN01180

SEQ ID NO: 105564 - RNA, 1410 nt, Artificial Sequence
  derived and/or modified sequence opt2 from neuraminidase__InfluenzaA__AAN01181
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucggcgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105565 - RNA, 1410 nt, Artificial Sequence; identical to SEQ ID NO: 105552
  derived and/or modified sequence opt2 from neuraminidase__InfluenzaA__AAN01182

SEQ ID NO: 105566 - RNA, 1410 nt, Artificial Sequence; identical to SEQ ID NO: 105552
  derived and/or modified sequence opt2 from neuraminidase__InfluenzaA__AAN01183

SEQ ID NO: 105567 - RNA, 1410 nt, Artificial Sequence; identical to SEQ ID NO: 105552
  derived and/or modified sequence opt2 from neuraminidase__InfluenzaA__AAN01184

SEQ ID NO: 105568 - RNA, 1410 nt, Artificial Sequence; identical to SEQ ID NO: 105552
  derived and/or modified sequence opt2 from neuraminidase__InfluenzaA__AAN01185

SEQ ID NO: 105569 - RNA, 1410 nt, Artificial Sequence
  derived and/or modified sequence opt2 from neuraminidase__InfluenzaA__AAN01186
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgccucggcuacgagaccuucaaggucaucgagggcugguccaaguccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105570 - RNA, 1410 nt, Artificial Sequence
  derived and/or modified sequence opt2 from neuraminidase__InfluenzaA__AAN01187
augaaccccaaccagaagaucaucaccaucggcuccgucucccucaccaucgccaccaucugcuuccucaugcagaucgccauccucgucaccaccgucacccuccacuucaagcaguacgagugcgacucccuccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagauguccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105571 - RNA, 1410 nt, Artificial Sequence; identical to SEQ ID NO: 105552
  derived and/or modified sequence opt2 from neuraminidase__InfluenzaA__AAN01188

SEQ ID NO: 105572 - RNA, 1410 nt, Artificial Sequence
  derived and/or modified sequence opt2 from neuraminidase__InfluenzaA__AAN64883
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcgacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105573 - RNA, 1410 nt, Artificial Sequence
  derived and/or modified sequence opt2 from neuraminidase__InfluenzaA__AAN64884
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105574 - RNA, 1410 nt, Artificial Sequence; identical to SEQ ID NO: 105573
  derived and/or modified sequence opt2 from neuraminidase__InfluenzaA__AAN64885

SEQ ID NO: 105575 - RNA, 1410 nt, Artificial Sequence; identical to SEQ ID NO: 105573
  derived and/or modified sequence opt2 from neuraminidase__InfluenzaA__AAN64886

SEQ ID NO: 105576 - RNA, 1410 nt, Artificial Sequence; identical to SEQ ID NO: 105573
  derived and/or modified sequence opt2 from neuraminidase__InfluenzaA__AAN64887

SEQ ID NO: 105577 - RNA, 1410 nt, Artificial Sequence
  derived and/or modified sequence opt2 from neuraminidase__InfluenzaA__AAN64888
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 105578 - RNA, 1410 nt, Artificial Sequence; identical to SEQ ID NO: 105573
  derived and/or modified sequence opt2 from neuraminidase__InfluenzaA__AAN64889

SEQ ID NO: 105579 - RNA, 1410 nt, Artificial Sequence
  derived and/or modified sequence opt2 from neuraminidase__InfluenzaA__AAN64890
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggagaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105580 - RNA, 1410 nt, Artificial Sequence; identical to SEQ ID NO: 105573
  derived and/or modified sequence opt2 from neuraminidase__InfluenzaA__AAN64891

SEQ ID NO: 105581 - RNA, 1410 nt, Artificial Sequence
  derived and/or modified sequence opt2 from neuraminidase__InfluenzaA__AAO46212
augaaccccaaccagaagaucaucaccaucggcuccgucucccucaccaucgagaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgacaccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 105582 - RNA, 1410 nt, Artificial Sequence
  derived and/or modified sequence opt2 from neuraminidase__InfluenzaA__AAO46213
augaaccccaaccagaagaucaucaccaucgacuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgacaccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 105583 - RNA, 1410 nt, Artificial Sequence
  derived and/or modified sequence opt2 from neuraminidase__InfluenzaA__AAO46214
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggccgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaucugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105584 - RNA, 1410 nt, Artificial Sequence
  derived and/or modified sequence opt2 from neuraminidase__InfluenzaA__AAO46215
augaaccccaaccagaagaucaucaccaucggcuccgucucccucaccaucgccaccgucugcuuccucaugcagaucgccauccucgccaccaccgucacccuccacuucaagcagcacgagugcgacucccccaccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacggcgacuccuccuccaacuccaacugccgcgaccccaacaacgagcgcggcaaccccggcgucaagggcugggccuucgacaacggcgacgacgucuggaugggccgcaccaucuccaaggagucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 105585 - RNA, 1410 nt, Artificial Sequence
  derived and/or modified sequence opt2 from neuraminidase__InfluenzaA__AAO46216
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucgagaacaagcacuccaacggcaccaagcacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgagggccgccucgucgacuccaucgucuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggacucccgcuccggcuacgagaccuucaaggucaucggcggcugguccacccccaacuccaagucccaggucaaccgccaggucaucgucgacuccaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 105586 - RNA, 1410 nt, Artificial Sequence
  derived and/or modified sequence opt2 from neuraminidase__InfluenzaA__AAO46217
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgaggacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccguccucgacaucuccauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcucccaggagacccgcgucugguggaccuccaacuccaucgucgucuucugcggcaccuccggcaccuacggcaccggcuccuggcccgacggcgccaacaucaacuucaugcccaucuga

SEQ ID NO: 105587 - RNA, 1410 nt, Artificial Sequence
  derived and/or modified sequence opt2 from neuraminidase__InfluenzaA__AAO46218
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgaggacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccguccucgacaucuccauggaggacuacuccaucggcuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcucccaggagacccgcgucugguggaccuccaacuccaucgucgucuucugcggcaccuccggcaccuacggcaccggcuccuggcccgacggcgccaacaucaacuucaugcccaucuga

SEQ ID NO: 105588 - RNA, 1410 nt, Artificial Sequence
  derived and/or modified sequence opt2 from neuraminidase__InfluenzaA__AAO46220
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggccgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaucugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105589 - RNA, 1410 nt, Artificial Sequence
  derived and/or modified sequence opt2 from neuraminidase__InfluenzaA__AAO46221
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggccgccgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaucugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105590 - RNA, 1410 nt, Artificial Sequence
  derived and/or modified sequence opt2 from neuraminidase__InfluenzaA__AAO46223
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105591 - RNA, 1410 nt, Artificial Sequence; identical to SEQ ID NO: 105590
  derived and/or modified sequence opt2 from neuraminidase__InfluenzaA__AAO46224

SEQ ID NO: 105592 - RNA, 1410 nt, Artificial Sequence
  derived and/or modified sequence opt2 from neuraminidase__InfluenzaA__AAO46225
augaaccccaaccagaagaucaucaccaucggcuucgucucccucaucaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccaagaucgucuaccucaacaacaccaccaucgagaaggagaucugccccgaggucgucgaguaccgcaacugguccaagccccagugccacaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucgucgacuccaucggcuccuggucccacaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacaacgacggcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105593 - RNA, 1410 nt, Artificial Sequence
  derived and/or modified sequence opt2 from neuraminidase__InfluenzaA__AAO46226
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacgagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105594 - RNA, 1410 nt, Artificial Sequence
  derived and/or modified sequence opt2 from neuraminidase__InfluenzaA__AAO46229
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucauguaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccaucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105595 - RNA, 1410 nt, Artificial Sequence
  derived and/or modified sequence opt2 from neuraminidase__InfluenzaA__AAO46230
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaaccucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105596 - RNA, 1410 nt, Artificial Sequence
  derived and/or modified sequence opt2 from neuraminidase__InfluenzaA__AAO46231
augaaccccaaccagaagaucaucaccaucggcuccgucucccucaccaucgccaccgucugcuuccucaugcagaucgccauccucgucaccaccgucacccuccacuucaagcagcacgacugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccgucaagugcuaccaguucgcccucggccagggcaccacccucgacaacaagcacuccaacgacaccguccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105597 - RNA, 1410 nt, Artificial Sequence
  derived and/or modified sequence opt2 from neuraminidase__InfluenzaA__AAO46232
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaccaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccaucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105598 - RNA, 1410 nt, Artificial Sequence
  derived and/or modified sequence opt2 from neuraminidase__InfluenzaA__AAO46233
augaaccccaaccagaagaucaucaccaucggcuccgucucccucaccaucgccgccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaaccgcuccggcuacuccggcaucuucuccgucgagggcaagggcugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105599 - RNA, 1410 nt, Artificial Sequence
  derived and/or modified sequence opt2 from neuraminidase__InfluenzaA__AAO46235
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105600 - RNA, 1410 nt, Artificial Sequence
  derived and/or modified sequence opt2 from neuraminidase__InfluenzaA__AAO46236
augaaccccaaccagaagaucaucaccaucggcuccgucucccucaccaucgccaccgucugcuuccucaugcacaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105601 - RNA, 1410 nt, Artificial Sequence
  derived and/or modified sequence opt2 from neuraminidase__InfluenzaA__AAO46237
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaagaucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105602 - RNA, 1410 nt, Artificial Sequence
  derived and/or modified sequence opt2 from neuraminidase__InfluenzaA__AAO46238
augaaccccaaccagaagaucaucaccaucggcuccgccucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaagaucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagaagggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaaccucaugcccaucuga

SEQ ID NO: 105603 - RNA, 1410 nt, Artificial Sequence
  derived and/or modified sequence opt2 from neuraminidase__InfluenzaA__AAO46241
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucggcuaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105604 - RNA, 1410 nt, Artificial Sequence
  derived and/or modified sequence opt2 from neuraminidase__InfluenzaA__AAO46245
augaaccccaaccagaagaucaucaccaucggcuccgucucccucaccaucgccaccgucugcuuccucaugcagaucgccauccucgucaccaccgucacccuccacuucaagcagcacgacugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccgucaagugcuaccaguucgcccucggccagggcaccacccucgacaacaagcacuccaacgacaccguccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucgccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcacccagggcgucaagggcugggccuucgacaacggcaacgaccucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105605 - RNA, 1410 nt, Artificial Sequence
  derived and/or modified sequence opt2 from neuraminidase__InfluenzaA__AAO46246
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaucaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgccgucuucugcggcaccuccggcaccuacggcaccggcuccuggcccgacggcgccaacaucaacuucaugcccaucuga

SEQ ID NO: 105606 - RNA, 1410 nt, Artificial Sequence
  derived and/or modified sequence opt2 from neuraminidase__InfluenzaA__AAO46247
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105607 - RNA, 1410 nt, Artificial Sequence
  derived and/or modified sequence opt2 from neuraminidase__InfluenzaA__AAO46462
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105608 - RNA, 1410 nt, Artificial Sequence; identical to SEQ ID NO: 105607
  derived and/or modified sequence opt2 from neuraminidase__InfluenzaA__AAO46463

SEQ ID NO: 105609 - RNA, 1410 nt, Artificial Sequence; identical to SEQ ID NO: 105607
  derived and/or modified sequence opt2 from neuraminidase__InfluenzaA__AAO46464

SEQ ID NO: 105610 - RNA, 1410 nt, Artificial Sequence; identical to SEQ ID NO: 105607
  derived and/or modified sequence opt2 from neuraminidase__InfluenzaA__AAO46465

SEQ ID NO: 105611 - RNA, 1410 nt, Artificial Sequence; identical to SEQ ID NO: 105607
  derived and/or modified sequence opt2 from neuraminidase__InfluenzaA__AAO46466

SEQ ID NO: 105612 - RNA, 1410 nt, Artificial Sequence
  derived and/or modified sequence opt2 from neuraminidase__InfluenzaA__AAO46467
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucaccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105613 - RNA, 1410 nt, Artificial Sequence
  derived and/or modified sequence opt2 from neuraminidase__InfluenzaA__AAO46468
augaaccccaaccagaagaucaucaccaucggcuccgucucccucaccaucgccaccgucugcuuccucaugcagaucgccauccucgucaccaccgucacccuccacuucaagcaguacgagugcgacuuccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105614 - RNA, 1410 nt, Artificial Sequence; identical to SEQ ID NO: 105607
  derived and/or modified sequence opt2 from neuraminidase__InfluenzaA__AAO46469

SEQ ID NO: 105615 - RNA, 1410 nt, Artificial Sequence
  derived and/or modified sequence opt2 from neuraminidase__InfluenzaA__AAO46471
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105616 - RNA, 1410 nt, Artificial Sequence
  derived and/or modified sequence opt2 from neuraminidase__InfluenzaA__AAO46472
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaccaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucuccggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105617 - RNA, 1410 nt, Artificial Sequence; identical to SEQ ID NO: 105607
  derived and/or modified sequence opt2 from neuraminidase__InfluenzaA__AAO46473

SEQ ID NO: 105618 - RNA, 1410 nt, Artificial Sequence; identical to SEQ ID NO: 105607
  derived and/or modified sequence opt2 from neuraminidase__InfluenzaA__AAO46474

SEQ ID NO: 105619 - RNA, 1410 nt, Artificial Sequence; identical to SEQ ID NO: 105607
  derived and/or modified sequence opt2 from neuraminidase__InfluenzaA__AAO46475

SEQ ID NO: 105620 - RNA, 1410 nt, Artificial Sequence
  derived and/or modified sequence opt2 from neuraminidase__InfluenzaA__AAO46476
augaaccccaaccagaagaucaucaccaucggcuccgucucccucaccaucgccaccgucugcuuccucaugcagaucgccauccucgucaccaccgucacccuccacuuccgccaguacgagugcgacucccccgccaacaaccaggucaugcccugcgagcccaccaucaucgagcgcaacaucaccgagaucgucuaccucaacaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucgaggacuacuccaucgacuccuccuacgucugcuccggccucgucggcgacaccccccgcaacaacgaccgcuccuccaacuccaacugccgcaaccccaacaacgagcgcggcaaccacggcgucaagggcugggccuucgacgacggcaacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105621 - RNA, 1410 nt, Artificial Sequence; identical to SEQ ID NO: 105607
  derived and/or modified sequence opt2 from neuraminidase__InfluenzaA__AAO46477

SEQ ID NO: 105622 - RNA, 1410 nt, Artificial Sequence
  derived and/or modified sequence opt2 from neuraminidase__InfluenzaA__AAO46478
augaaccccaaccagaagaucaucaccaucggcuccgucucccucaucaucgccaccgucugcuuccucaugcagaucgccauccucgucaccaccgucacccuccacuucaagcagcacgagugcgacucccccuccuccaaccaggucaugcccugcgagcccaucaucaucgagcgcaacaucaccgagaucgucuaccucaacaacaccaccaucgagaaggagaccugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcaacgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccaucgucgacaucaacaugaaggacuacuccaucgacuccuccuacgucugcuccggccucgucggcgacaccccccgcaacgacgaccgcuccuccaaguccaacugccgcaaccccaacaacgagcgcggcaaccacggcgucaagggcugggccuucgacaacggcaacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105623 - RNA, 1410 nt, Artificial Sequence
  derived and/or modified sequence opt2 from neuraminidase__InfluenzaA__AAO46479
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccgcgucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 105624 - RNA, 1410 nt, Artificial Sequence
  derived and/or modified sequence opt2 from neuraminidase__InfluenzaA__AAO46481
augaaccccaaccagaagaucaucaccaucggcuccgucucccucaccaucgccaccgucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacucccgcuacgucugcuccggccucgucggcgacaccccccgcaacaacgaccgcuccuccaacuccaacugccgcaaccccaacaacgagcgcggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgaguccaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105625 - RNA, 1410 nt, Artificial Sequence
  derived and/or modified sequence opt2 from neuraminidase__InfluenzaA__AAO46482
augaaccccaaccagaagaucaucaccaucggcuccgucucccucaccaucgccaccgucugcuuccucaugcagaucgccauccucgucaccaccgucacccuccacuucaagcaguacgagugcgacucccccgccaacaaccaggucaugcccugcgagcccaugaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacucccgcuacgucugcuccggccucgucggcgacaccccccgcaacaacgaccgcuccuccaacuccaacugccgcaaccccaacaacgacaagggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105626 - RNA, 1410 nt, Artificial Sequence
  derived and/or modified sequence opt2 from neuraminidase__InfluenzaA__AAO46483
augaaccccaaccagaagaucaucaccaucggcuccgucucccucaccaucgccaccgucugcuuccucaugcagaucgccauccucgucaccaccgucacccuccacuuccgccaguacgagugcgacucccccgccaacaaccaggucaugcccugcgagcccaucaucaucgagcgcaacaucaccgagaucgucuaccucaacaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucgaggacuacuccaucgacuccuccuacgucugcuccggccucgucggcgacaccccccgcaacaacgaccgcuccuccaacuccaacugccgcaaccccaacaacgagcgcggcaaccacggcgucaagggcugggccuucgacgacggcaacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105627 - RNA, 1410 nt, Artificial Sequence
  derived and/or modified sequence opt2 from neuraminidase__InfluenzaA__AAO46485
augaaccccaaccagaagaucaucaccaucggcuccgucucccucaccaucgccaccgucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacucccgcuacgucugcuccggccucgucggcgacaccccccgcaacaacgaccgcuccuccaacuccaacugccgcaaccccaacaacgacaagggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105628 - RNA, 1410 nt, Artificial Sequence
  derived and/or modified sequence opt2 from neuraminidase__InfluenzaA__AAO46486
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagcgcggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105629 - RNA, 1410 nt, Artificial Sequence
  derived and/or modified sequence opt2 from neuraminidase__InfluenzaA__AAO46489
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggcaaggccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagcgcggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105630 - RNA, 1410 nt, Artificial Sequence
  derived and/or modified sequence opt2 from neuraminidase__InfluenzaA__AAO46491
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105631 - RNA, 1410 nt, Artificial Sequence; identical to SEQ ID NO: 105630
  derived and/or modified sequence opt2 from neuraminidase__InfluenzaA__AAO46492

SEQ ID NO: 105632 - RNA, 1410 nt, Artificial Sequence
  derived and/or modified sequence opt2 from neuraminidase__InfluenzaA__AAO88264
augaacaccaaccagcgcaucaucaccaucggcaccgucugccucaucgucggcaucgucucccuccuccuccagaucggcaacaucgucucccucuggaucucccacuccauccagaccggcaagaagaacuacuccaagaucugcuccaaguccgucaucaccuacgagaacaacaccugggucaaccagaccuacgucaacaucuccaacaucaacaucgccgacggccagggcgucaacuccaucauccucgccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgacgcccccaacuaccacuacgaggagugcuccugcuaccccgacaccggcaaggucgucugcgucugcuccgacaacuggcacgccuccaaccgccccugggucuccuucgaccagaaccucgacuaccagaucggcuacaucugcuccggcgucuucggcgacaacccccgcuccaacgacggccgcggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaucaagcaggacgucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucgacuccgagaccgccuccugguccuggcccgacggcgccgaccuccccuucaccaucgacaaguga

SEQ ID NO: 105633 - RNA, 1410 nt, Artificial Sequence
  derived and/or modified sequence opt2 from neuraminidase__InfluenzaA__AAQ10334
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105634 - RNA, 1410 nt, Artificial Sequence; identical to SEQ ID NO: 105633
  derived and/or modified sequence opt2 from neuraminidase__InfluenzaA__AAQ10335

SEQ ID NO: 105635 - RNA, 1410 nt, Artificial Sequence
  derived and/or modified sequence opt2 from neuraminidase__InfluenzaA__AAQ10336
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgagaucaaccucaugcccaucuga

SEQ ID NO: 105636 - RNA, 1410 nt, Artificial Sequence; identical to SEQ ID NO: 105633
  derived and/or modified sequence opt2 from neuraminidase__InfluenzaA__AAQ10337

SEQ ID NO: 105637 - RNA, 1410 nt, Artificial Sequence
  derived and/or modified sequence opt2 from neuraminidase__InfluenzaA__AAQ10339
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagacccuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105638 - RNA, 1410 nt, Artificial Sequence
  derived and/or modified sequence opt2 from neuraminidase__InfluenzaA__AAQ10341
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105639 - RNA, 1410 nt, Artificial Sequence
  derived and/or modified sequence opt2 from neuraminidase__InfluenzaA__AAQ10343
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgccuucugcggcaccuccggcaccuacggcaccggcuccuggcccgacggcgccgacaucaaccucaugcccaucuga

SEQ ID NO: 105640 - RNA, 1191 nt, Artificial Sequence
  derived and/or modified sequence opt2 from neuraminidase__InfluenzaA__AAQ10344
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggccaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaacuccaaguccuga

SEQ ID NO: 105641 - RNA, 1416 nt, Artificial Sequence
  derived and/or modified sequence opt2 from neuraminidase__InfluenzaA__AAR11366
augaaccccaaccagaagcucuucgcccucuccggcgucgccaucgcccucuccguccucaaccuccucaucggcaucuccaacgucggccucaacgucucccuccaccucaaggagaagggccccaagcaggaggagaaccucaccugcaccaccaucaaccagaacaacaccaccgucgucgagaacaccuacgucaacaacaccaccaucaucaccaagggcaccgaccucaagacccccuccuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaugugcgucggcugguccuccaccaccugccacgacggcaucgcccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggccuacaccaaggucauguacuuccacaagggccucgucgucaaggaggaggagcuccgcggcuccgcccgccacaucgaggagugcuccugcuacggccacaaccagaaggucaccugcgucugccgcgacaacuggcagggcgccaaccgccccaucaucgagaucgacaugaacacccucgagcacaccucccgcuacgucugcaccggcauccucaccgacaccucccgccccggcgacaaguccuccggcgacugcuccaaccccaucaccggcucccccggcgcccccggcgucaagggcuucggcuuccucaacggcgacaacaccuggcucggccgcaccaucuccccccgcucccgcuccggcuucgagaugcucaagauccccaacgccggcaccgaccccaacucccgcaucgccgagcgccaggagaucgucgacaacaacaacugguccggcuacuccggcuccuucaucgacuacuggaacgacaacuccgagugcuacaaccccugcuucuacgucgagcucauccgcggccgccccgaggaggccaaguacgucugguggaccuccaacucccucaucgcccucugcggcucccccuuccccgucggccccggcuccuuccccgacggcgcccagauccaguacuucuccuga

SEQ ID NO: 105642 - RNA, 1350 nt, Artificial Sequence
  derived and/or modified sequence opt2 from neuraminidase__InfluenzaA__AAS89005
augaaccccaacaagaagaucaucaccaucggcuccaucugcauggucaccggcauggucucccucaugcuccagaucggcaaccucaucuccaucugggucucccacuccauccacaccggcaaccagcagaaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaucgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 105643 - RNA, 1350 nt, Artificial Sequence
  derived and/or modified sequence opt2 from neuraminidase__InfluenzaA__AAS89006
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 105644 - RNA, 1410 nt, Artificial Sequence
  derived and/or modified sequence opt2 from neuraminidase__InfluenzaA__AAT38822
augaaccccaaccagaagaucaucaccaucggcgucgucaacaccacccucuccaccaucgcccucuucaucggcgucggcaaccucgucuucaacaccgucauccacgagaagaucggcgaccaccagaucgucacccaccccaccaucaugacccccgagguccccaacugcuccgacaccaucaucaccuacaacaacaccgucaucaacaacaucaccaccaccaucaucaccgaggccgagcgccccuucaaguccccccucccccucugccccuuccgcggcuucuuccccuuccacaaggacaacgccauccgccucggcgagaacaaggacgucaucgucacccgcgagcccuacgucuccugcgacaacgacaacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcaucgccugguccuccuccuccugcuucgacggcaaggaguggaugcacgucugcaugaccggcaacgacaacgacgccuccgcccagaucaucuacggcggccgcaugaccgacuccaucaaguccuggcgcaaggacauccuccgcacccaggaguccgagugccagugcaucgacggcaccugcgucgucgccgucaccgacggccccgccgccaacuccgccgaccaccgcgucuacuggauccgcgagggccgcaucaucaaguacgagaacguccccaagaccaagauccagcaccucgaggagugcuccugcuacgucgacaucgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaucauguccugcgacucccccuccaacgucaacggcggccccggcgucaagggcuucggcuucaaggccggcaacgacgucuggcucggccgcaccgucuccaccuccggccgcuccggcuucgagaucaucaaggucaccgagggcuggaucaacucccccaaccacgucaaguccaucacccagacccucgucuccaacaacgacugguccggcuacuccggcuccuucaucgucaaggccaaggacugcuuccagcccugcuucuacgucgagcucauccgcggccgccccaacaagaacgacgacgucuccuggaccuccaacuccaucgucaccuucugcggccucgacaacgagcccggcuccggcaacuggcccgacggcuccaacaucggcuucaugcccaaguga

SEQ ID NO: 105645 - RNA, 1350 nt, Artificial Sequence; identical to SEQ ID NO: 105643
  derived and/or modified sequence opt2 from neuraminidase__InfluenzaA__AAV65827

SEQ ID NO: 105646 - RNA, 1410 nt, Artificial Sequence
  derived and/or modified sequence opt2 from neuraminidase__InfluenzaA__AAX11488
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccgcccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105647 - RNA, 1410 nt, Artificial Sequence
  derived and/or modified sequence opt2 from neuraminidase__InfluenzaA__AAX11508
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105648 - RNA, 1410 nt, Artificial Sequence
  derived and/or modified sequence opt2 from neuraminidase__InfluenzaA__AAX11538
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgagcgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105649 - RNA, 1410 nt, Artificial Sequence
  derived and/or modified sequence opt2 from neuraminidase__InfluenzaA__AAX11548
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105650 - RNA, 1410 nt, Artificial Sequence; identical to SEQ ID NO: 105647
  derived and/or modified sequence opt2 from neuraminidase__InfluenzaA__AAX11558

SEQ ID NO: 105651 - RNA, 1410 nt, Artificial Sequence
  derived and/or modified sequence opt2 from neuraminidase__InfluenzaA__AAX11568
augaaccccaaccagaagaucaucaccaucggcuccgucucccucaccaucgccaccaucugcuuccucaugcagaucgccauccucgucaccaccgucacccuccacuucaagcagcacgagugcuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105652 - RNA, 1410 nt, Artificial Sequence; identical to SEQ ID NO: 105647
  derived and/or modified sequence opt2 from neuraminidase__InfluenzaA__AAX11578

SEQ ID NO: 105653 - RNA, 1410 nt, Artificial Sequence
  derived and/or modified sequence opt2 from neuraminidase__InfluenzaA__AAX11588
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcaucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggagaagaccgaggucugguggaccuccaacuccaucgucgucuucugcggcaccuccggcaccuacggcaccggcuccuggcccgacggcgccgacaucaaccucaugcccaucuga

SEQ ID NO: 105654 - RNA, 1410 nt, Artificial Sequence; identical to SEQ ID NO: 105649
  derived and/or modified sequence opt2 from neuraminidase__InfluenzaA__AAX11598

SEQ ID NO: 105655 - RNA, 1410 nt, Artificial Sequence; identical to SEQ ID NO: 105649
  derived and/or modified sequence opt2 from neuraminidase__InfluenzaA__AAX11608

SEQ ID NO: 105656 - RNA, 1410 nt, Artificial Sequence
  derived and/or modified sequence opt2 from neuraminidase__InfluenzaA__AAX11618
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccgcccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105657 - RNA, 1410 nt, Artificial Sequence
  derived and/or modified sequence opt2 from neuraminidase__InfluenzaA__AAX12744
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105658 - RNA, 1410 nt, Artificial Sequence; identical to SEQ ID NO: 105649
  derived and/or modified sequence opt2 from neuraminidase__InfluenzaA__AAX12754

SEQ ID NO: 105659 - RNA, 1410 nt, Artificial Sequence
  derived and/or modified sequence opt2 from neuraminidase__InfluenzaA__AAX12774
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105660 - RNA, 1410 nt, Artificial Sequence
  derived and/or modified sequence opt2 from neuraminidase__InfluenzaA__AAX12804
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacaacuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105661 - RNA, 1410 nt, Artificial Sequence
  derived and/or modified sequence opt2 from neuraminidase__InfluenzaA__AAX12814
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105662 - RNA, 1410 nt, Artificial Sequence
  derived and/or modified sequence opt2 from neuraminidase__InfluenzaA__AAX34064
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagcgcgagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105663 - RNA, 1410 nt, Artificial Sequence
  derived and/or modified sequence opt2 from neuraminidase__InfluenzaA__AAX35824
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucgccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105664 - RNA, 1410 nt, Artificial Sequence; identical to SEQ ID NO: 105647
  derived and/or modified sequence opt2 from neuraminidase__InfluenzaA__AAX35834

SEQ ID NO: 105665 - RNA, 1410 nt, Artificial Sequence
  derived and/or modified sequence opt2 from neuraminidase__InfluenzaA__AAX35844
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccaacucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguucaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105666 - RNA, 1410 nt, Artificial Sequence
  derived and/or modified sequence opt2 from neuraminidase__InfluenzaA__AAX35854
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105667 - RNA, 1410 nt, Artificial Sequence
  derived and/or modified sequence opt2 from neuraminidase__InfluenzaA__AAX35864
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105668 - RNA, 1410 nt, Artificial Sequence
  derived and/or modified sequence opt2 from neuraminidase__InfluenzaA__AAX47538
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgaggaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105669 - RNA, 1410 nt, Artificial Sequence; identical to SEQ ID NO: 105647
  derived and/or modified sequence opt2 from neuraminidase__InfluenzaA__AAX56383

SEQ ID NO: 105670 - RNA, 1410 nt, Artificial Sequence
  derived and/or modified sequence opt2 from neuraminidase__InfluenzaA__AAX56393
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggcaagggcaccacccucaacaacggccacuccaacaacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105671 - RNA, 1410 nt, Artificial Sequence; identical to SEQ ID NO: 105647
  derived and/or modified sequence opt2 from neuraminidase__InfluenzaA__AAX56413

SEQ ID NO: 105672 - RNA, 1410 nt, Artificial Sequence; identical to SEQ ID NO: 105649
  derived and/or modified sequence opt2 from neuraminidase__InfluenzaA__AAX56423

SEQ ID NO: 105673 - RNA, 1410 nt, Artificial Sequence; identical to SEQ ID NO: 105647
  derived and/or modified sequence opt2 from neuraminidase__InfluenzaA__AAX56433

SEQ ID NO: 105674 - RNA, 1410 nt, Artificial Sequence; identical to SEQ ID NO: 105666
  derived and/or modified sequence opt2 from neuraminidase__InfluenzaA__AAX56443

SEQ ID NO: 105675 - RNA, 1410 nt, Artificial Sequence
  derived and/or modified sequence opt2 from neuraminidase__InfluenzaA__AAX56473
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaagaacugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105676 - RNA, 1410 nt, Artificial Sequence
  derived and/or modified sequence opt2 from neuraminidase__InfluenzaA__AAX56483
augaaccccaaccagaagaucaucaccaucggcuccgucucccucaccaucgccaccaucugcuuccucaugcagaucgccauccucgucaccaccgucacccuccacuucaagcaguacgagugcgacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105677 - RNA, 1410 nt, Artificial Sequence; identical to SEQ ID NO: 105676
  derived and/or modified sequence opt2 from neuraminidase__InfluenzaA__AAX56503

SEQ ID NO: 105678 - RNA, 1410 nt, Artificial Sequence
  derived and/or modified sequence opt2 from neuraminidase__InfluenzaA__AAX56513
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105679 - RNA, 1413 nt, Artificial Sequence
  derived and/or modified sequence opt2 from neuraminidase__InfluenzaA__AAX56533
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagcgcaucaucaccuacgagaaccgcaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaacgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 105680 - RNA, 1410 nt, Artificial Sequence
  derived and/or modified sequence opt2 from neuraminidase__InfluenzaA__AAX56543
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccuccggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgaggagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105681 - RNA, 1410 nt, Artificial Sequence; identical to SEQ ID NO: 105573
  derived and/or modified sequence opt2 from neuraminidase__InfluenzaA__AAX56553

SEQ ID NO: 105682 - RNA, 1410 nt, Artificial Sequence
  derived and/or modified sequence opt2 from neuraminidase__InfluenzaA__AAX56563
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccgcccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcgacaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105683 - RNA, 1410 nt, Artificial Sequence
  derived and/or modified sequence opt2 from neuraminidase__InfluenzaA__AAX56573
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105684 - RNA, 1410 nt, Artificial Sequence
  derived and/or modified sequence opt2 from neuraminidase__InfluenzaA__AAX56583
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgaccacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105685 - RNA, 1410 nt, Artificial Sequence
  derived and/or modified sequence opt2 from neuraminidase__InfluenzaA__AAX56593
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105686 - RNA, 1410 nt, Artificial Sequence
  derived and/or modified sequence opt2 from neuraminidase__InfluenzaA__AAX56603
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccgcccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105687 - RNA, 1410 nt, Artificial Sequence; identical to SEQ ID NO: 105657
  derived and/or modified sequence opt2 from neuraminidase__InfluenzaA__AAX57647

SEQ ID NO: 105688 - RNA, 1410 nt, Artificial Sequence; identical to SEQ ID NO: 105647
  derived and/or modified sequence opt2 from neuraminidase__InfluenzaA__AAX57657

SEQ ID NO: 105689 - RNA, 1410 nt, Artificial Sequence; identical to SEQ ID NO: 105685
  derived and/or modified sequence opt2 from neuraminidase__InfluenzaA__AAX57667

SEQ ID NO: 105690 - RNA, 1410 nt, Artificial Sequence; identical to SEQ ID NO: 105666
  derived and/or modified sequence opt2 from neuraminidase__InfluenzaA__AAX57677

SEQ ID NO: 105691 - RNA, 1410 nt, Artificial Sequence
  derived and/or modified sequence opt2 from neuraminidase__InfluenzaA__AAX57687
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105692 - RNA, 1410 nt, Artificial Sequence
  derived and/or modified sequence opt2 from neuraminidase__InfluenzaA__AAX57697
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105693 - RNA, 1410 nt, Artificial Sequence
  derived and/or modified sequence opt2 from neuraminidase__InfluenzaA__AAX57707
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105694 - RNA, 1410 nt, Artificial Sequence; identical to SEQ ID NO: 105666
  derived and/or modified sequence opt2 from neuraminidase__InfluenzaA__AAX57717

SEQ ID NO: 105695 - RNA, 1410 nt, Artificial Sequence; identical to SEQ ID NO: 105685
  derived and/or modified sequence opt2 from neuraminidase__InfluenzaA__AAX57726

SEQ ID NO: 105696 - RNA, 1410 nt, Artificial Sequence; identical to SEQ ID NO: 105685
  derived and/or modified sequence opt2 from neuraminidase__InfluenzaA__AAX57737

SEQ ID NO: 105697 - RNA, 1410 nt, Artificial Sequence; identical to SEQ ID NO: 105573
  derived and/or modified sequence opt2 from neuraminidase__InfluenzaA__AAX57747

SEQ ID NO: 105698 - RNA, 1410 nt, Artificial Sequence; identical to SEQ ID NO: 105573
  derived and/or modified sequence opt2 from neuraminidase__InfluenzaA__AAX57757

SEQ ID NO: 105699 - RNA, 1410 nt, Artificial Sequence
  derived and/or modified sequence opt2 from neuraminidase__InfluenzaA__AAX57767
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105700 - RNA, 1410 nt, Artificial Sequence
  derived and/or modified sequence opt2 from neuraminidase__InfluenzaA__AAX57777
augaaccccaaccagaagaucaucaccaucggcuccgucucccucaucaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105701 - RNA, 1410 nt, Artificial Sequence
  derived and/or modified sequence opt2 from neuraminidase__InfluenzaA__AAX57787
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccaacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105702 - RNA, 1410 nt, Artificial Sequence; identical to SEQ ID NO: 105573
  derived and/or modified sequence opt2 from neuraminidase__InfluenzaA__AAX57797

SEQ ID NO: 105703 - RNA, 1410 nt, Artificial Sequence; identical to SEQ ID NO: 105573
  derived and/or modified sequence opt2 from neuraminidase__InfluenzaA__AAX57807

SEQ ID NO: 105704 - RNA, 1410 nt, Artificial Sequence
  derived and/or modified sequence opt2 from neuraminidase__InfluenzaA__AAX57817
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucuccuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105705 - RNA, 1410 nt, Artificial Sequence; identical to SEQ ID NO: 105573
  derived and/or modified sequence opt2 from neuraminidase__InfluenzaA__AAX57837

SEQ ID NO: 105706 - RNA, 1410 nt, Artificial Sequence
  derived and/or modified sequence opt2 from neuraminidase__InfluenzaA__AAX57847
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105707 - RNA, 1410 nt, Artificial Sequence
  derived and/or modified sequence opt2 from neuraminidase__InfluenzaA__AAX57857
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaccaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105708 - RNA, 1410 nt, Artificial Sequence; identical to SEQ ID NO: 105573
  derived and/or modified sequence opt2 from neuraminidase__InfluenzaA__AAX57867

SEQ ID NO: 105709 - RNA, 1410 nt, Artificial Sequence
  derived and/or modified sequence opt2 from neuraminidase__InfluenzaA__AAX57877
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcacaucuga

SEQ ID NO: 105710 - RNA, 1410 nt, Artificial Sequence; identical to SEQ ID NO: 105573
  derived and/or modified sequence opt2 from neuraminidase__InfluenzaA__AAX57887

SEQ ID NO: 105711 - RNA, 1410 nt, Artificial Sequence
  derived and/or modified sequence opt2 from neuraminidase__InfluenzaA__AAX57897
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacuccggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105712 - RNA, 1410 nt, Artificial Sequence
  derived and/or modified sequence opt2 from neuraminidase__InfluenzaA__AAX57907
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaugaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105713 - RNA, 1410 nt, Artificial Sequence; identical to SEQ ID NO: 105573
  derived and/or modified sequence opt2 from neuraminidase__InfluenzaA__AAX57917

SEQ ID NO: 105714 - RNA, 1410 nt, Artificial Sequence; identical to SEQ ID NO: 105573
  derived and/or modified sequence opt2 from neuraminidase__InfluenzaA__AAX57927

SEQ ID NO: 105715 - RNA, 1410 nt, Artificial Sequence
  derived and/or modified sequence opt2 from neuraminidase__InfluenzaA__AAX57937
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagauggucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcgcaucuga

SEQ ID NO: 105716 - RNA, 1410 nt, Artificial Sequence
  derived and/or modified sequence opt2 from neuraminidase__InfluenzaA__AAX57947
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccuggucccgcaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgccuccuccuacaugugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105717 - RNA, 1410 nt, Artificial Sequence; identical to SEQ ID NO: 105657
  derived and/or modified sequence opt2 from neuraminidase__InfluenzaA__AAX76626

SEQ ID NO: 105718 - RNA, 1410 nt, Artificial Sequence
  derived and/or modified sequence opt2 from neuraminidase__InfluenzaA__AAX76646
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccacgaccgcacccccuaccgcacccuccucaugaacgagcucggcguccccuuccaccucggcacccgccaggucugcaucgccugguccuccuccggcugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105719 - RNA, 1410 nt, Artificial Sequence; identical to SEQ ID NO: 105647
  derived and/or modified sequence opt2 from neuraminidase__InfluenzaA__AAX76656

SEQ ID NO: 105720 - RNA, 1410 nt, Artificial Sequence; identical to SEQ ID NO: 105692
  derived and/or modified sequence opt2 from neuraminidase__InfluenzaA__AAX76666

SEQ ID NO: 105721 - RNA, 1410 nt, Artificial Sequence; identical to SEQ ID NO: 105573
  derived and/or modified sequence opt2 from neuraminidase__InfluenzaA__AAX76696

SEQ ID NO: 105722 - RNA, 1410 nt, Artificial Sequence
  derived and/or modified sequence opt2 from neuraminidase__InfluenzaA__AAX76736
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucuccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucucccgcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105723 - RNA, 1410 nt, Artificial Sequence
  derived and/or modified sequence opt2 from neuraminidase__InfluenzaA__AAX76766
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgucggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105724 - RNA, 1410 nt, Artificial Sequence; identical to SEQ ID NO: 105649
  derived and/or modified sequence opt2 from neuraminidase__InfluenzaA__AAY18089

SEQ ID NO: 105725 - RNA, 1410 nt, Artificial Sequence
  derived and/or modified sequence opt2 from neuraminidase__InfluenzaA__AAY18099
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucgucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105726 - RNA, 1410 nt, Artificial Sequence
  derived and/or modified sequence opt2 from neuraminidase__InfluenzaA__AAY18109
augaaccccaaccagaagaucaucaccaucggcuccgucucccucaccaucgccaccaucugcuuccucaugcagaucgccauccucgucaccacccucacccuccacuucaagcaguacgagugcaacuccccccccaacaaccaggucaugcucugcgagcccgccaucaucgagcgcaacaucaccgagaucgucuaccucaccaacaccaccaucgagaaggagaagugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105727 - RNA, 1410 nt, Artificial Sequence; identical to SEQ ID NO: 105685
  derived and/or modified sequence opt2 from neuraminidase__InfluenzaA__AAY18119

SEQ ID NO: 105728 - RNA, 1410 nt, Artificial Sequence
  derived and/or modified sequence opt2 from neuraminidase__InfluenzaA__AAY18129
augaaccccaaccagaagaucaucaccaucggcuccgucucccucaccaucgccaccaucugcuuccucaugcagaucaccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaguccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105729 - RNA, 1410 nt, Artificial Sequence
  derived and/or modified sequence opt2 from neuraminidase__InfluenzaA__AAY18139
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagcgcgagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105730 - RNA, 1410 nt, Artificial Sequence
  derived and/or modified sequence opt2 from neuraminidase__InfluenzaA__AAY18149
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaccgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105731 - RNA, 1410 nt, Artificial Sequence
  derived and/or modified sequence opt2 from neuraminidase__InfluenzaA__AAY18159
augaaccccaaccagaagaucaucaccaucggcuccgucucccucaucaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaagaacugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105732 - RNA, 1410 nt, Artificial Sequence; identical to SEQ ID NO: 105573
  derived and/or modified sequence opt2 from neuraminidase__InfluenzaA__AAY18179

SEQ ID NO: 105733 - RNA, 1410 nt, Artificial Sequence; identical to SEQ ID NO: 105573
  derived and/or modified sequence opt2 from neuraminidase__InfluenzaA__AAY18189

SEQ ID NO: 105734 - RNA, 1410 nt, Artificial Sequence
  derived and/or modified sequence opt2 from neuraminidase__InfluenzaA__AAY18199
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccagggcgucaagggcugggccuucgacgacggcaacgacgucuggaugggccgcaccaucuccgagaagcuccacuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105735 - RNA, 1410 nt, Artificial Sequence; identical to SEQ ID NO: 105676
  derived and/or modified sequence opt2 from neuraminidase__InfluenzaA__AAY18588

SEQ ID NO: 105736 - RNA, 1410 nt, Artificial Sequence; identical to SEQ ID NO: 105657
  derived and/or modified sequence opt2 from neuraminidase__InfluenzaA__AAY18614

SEQ ID NO: 105737 - RNA, 1410 nt, Artificial Sequence
  derived and/or modified sequence opt2 from neuraminidase__InfluenzaA__AAY27846
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105738 - RNA, 1410 nt, Artificial Sequence
  derived and/or modified sequence opt2 from neuraminidase__InfluenzaA__AAY27856
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105739 - RNA, 1410 nt, Artificial Sequence; identical to SEQ ID NO: 105649
  derived and/or modified sequence opt2 from neuraminidase__InfluenzaA__AAY27866

SEQ ID NO: 105740 - RNA, 1410 nt, Artificial Sequence
  derived and/or modified sequence opt2 from neuraminidase__InfluenzaA__AAY27962
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacaacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105741 - RNA, 1410 nt, Artificial Sequence
  derived and/or modified sequence opt2 from neuraminidase__InfluenzaA__AAY27997
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccacgaccgcacccccuaccgcacccuccucaugaacgagaugggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105742 - RNA, 1410 nt, Artificial Sequence; identical to SEQ ID NO: 105647
  derived and/or modified sequence opt2 from neuraminidase__InfluenzaA__AAY28007

SEQ ID NO: 105743 - RNA, 1410 nt, Artificial Sequence; identical to SEQ ID NO: 105692
  derived and/or modified sequence opt2 from neuraminidase__InfluenzaA__AAY28017

SEQ ID NO: 105744 - RNA, 1410 nt, Artificial Sequence; identical to SEQ ID NO: 105647
  derived and/or modified sequence opt2 from neuraminidase__InfluenzaA__AAY28268

SEQ ID NO: 105745 - RNA, 1410 nt, Artificial Sequence
  derived and/or modified sequence opt2 from neuraminidase__InfluenzaA__AAY28278
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaagcccgagaccgaggucugguggaccuccaacuccaucgucgucuucugcggcaccuccggcaccuacggcaccggcuccuggcccgacggcgccgacaucaaccucaugcccaucuga

SEQ ID NO: 105746 - RNA, 1410 nt, Artificial Sequence; identical to SEQ ID NO: 105661
  derived and/or modified sequence opt2 from neuraminidase__InfluenzaA__AAY28288

SEQ ID NO: 105747 - RNA, 1410 nt, Artificial Sequence
  derived and/or modified sequence opt2 from neuraminidase__InfluenzaA__AAY28298
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcuggucccgccccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105748 - RNA, 1410 nt, Artificial Sequence; identical to SEQ ID NO: 105678
  derived and/or modified sequence opt2 from neuraminidase__InfluenzaA__AAY28308

SEQ ID NO: 105749 - RNA, 1410 nt, Artificial Sequence
  derived and/or modified sequence opt2 from neuraminidase__InfluenzaA__AAY28318
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcgccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105750 - RNA, 1410 nt, Artificial Sequence
  derived and/or modified sequence opt2 from neuraminidase__InfluenzaA__AAY28338
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagauccgccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105751 - RNA, 1410 nt, Artificial Sequence; identical to SEQ ID NO: 105657
  derived and/or modified sequence opt2 from neuraminidase__InfluenzaA__AAY28348

SEQ ID NO: 105752 - RNA, 1410 nt, Artificial Sequence; identical to SEQ ID NO: 105573
  derived and/or modified sequence opt2 from neuraminidase__InfluenzaA__AAY28358

SEQ ID NO: 105753 - RNA, 1410 nt, Artificial Sequence; identical to SEQ ID NO: 105657
  derived and/or modified sequence opt2 from neuraminidase__InfluenzaA__AAY28388

SEQ ID NO: 105754 - RNA, 1410 nt, Artificial Sequence; identical to SEQ ID NO: 105662
  derived and/or modified sequence opt2 from neuraminidase__InfluenzaA__AAY28398

SEQ ID NO: 105755 - RNA, 1410 nt, Artificial Sequence; identical to SEQ ID NO: 105676
  derived and/or modified sequence opt2 from neuraminidase__InfluenzaA__AAY28408

SEQ ID NO: 105756 - RNA, 1410 nt, Artificial Sequence; identical to SEQ ID NO: 105649
  derived and/or modified sequence opt2 from neuraminidase__InfluenzaA__AAY28505

SEQ ID NO: 105757 - RNA, 1410 nt, Artificial Sequence
  derived and/or modified sequence opt2 from neuraminidase__InfluenzaA__AAY28524
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacuacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105758 - RNA, 1410 nt, Artificial Sequence; identical to SEQ ID NO: 105647
  derived and/or modified sequence opt2 from neuraminidase__InfluenzaA__AAY28534

SEQ ID NO: 105759 - RNA, 1410 nt, Artificial Sequence
  derived and/or modified sequence opt2 from neuraminidase__InfluenzaA__AAY28544
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105760 - RNA, 1410 nt, Artificial Sequence; identical to SEQ ID NO: 105573
  derived and/or modified sequence opt2 from neuraminidase__InfluenzaA__AAY28554

SEQ ID NO: 105761 - RNA, 1410 nt, Artificial Sequence
  derived and/or modified sequence opt2 from neuraminidase__InfluenzaA__AAY28564
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcuggucccgccccaacuccaagcuccagaucaaccgccaggucaucgucgagcgcggcaaccgcuccggcuacuccggcaucuucuccgucgaguccaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105762 - RNA, 1410 nt, Artificial Sequence; identical to SEQ ID NO: 105647
  derived and/or modified sequence opt2 from neuraminidase__InfluenzaA__AAY28574

SEQ ID NO: 105763 - RNA, 1410 nt, Artificial Sequence; identical to SEQ ID NO: 105661
  derived and/or modified sequence opt2 from neuraminidase__InfluenzaA__AAY28584

SEQ ID NO: 105764 - RNA, 1410 nt, Artificial Sequence; identical to SEQ ID NO: 105573
  derived and/or modified sequence opt2 from neuraminidase__InfluenzaA__AAY28594

SEQ ID NO: 105765 - RNA, 1410 nt, Artificial Sequence
  derived and/or modified sequence opt2 from neuraminidase__InfluenzaA__AAY28611
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105766 - RNA, 1410 nt, Artificial Sequence; identical to SEQ ID NO: 105678
  derived and/or modified sequence opt2 from neuraminidase__InfluenzaA__AAY28651

SEQ ID NO: 105767 - RNA, 1410 nt, Artificial Sequence
  derived and/or modified sequence opt2 from neuraminidase__InfluenzaA__AAY44613
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagaucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105768 - RNA, 1410 nt, Artificial Sequence; identical to SEQ ID NO: 105661
  derived and/or modified sequence opt2 from neuraminidase__InfluenzaA__AAY44624

SEQ ID NO: 105769 - RNA, 1410 nt, Artificial Sequence; identical to SEQ ID NO: 105683
  derived and/or modified sequence opt2 from neuraminidase__InfluenzaA__AAY44634

SEQ ID NO: 105770 - RNA, 1410 nt, Artificial Sequence; identical to SEQ ID NO: 105676
  derived and/or modified sequence opt2 from neuraminidase__InfluenzaA__AAY44644

SEQ ID NO: 105771 - RNA, 1410 nt, Artificial Sequence
  derived and/or modified sequence opt2 from neuraminidase__InfluenzaA__AAY44654
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagauccaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105772 - RNA, 1410 nt, Artificial Sequence
  derived and/or modified sequence opt2 from neuraminidase__InfluenzaA__AAY44758
augaaccccaaccagaagaucaucaccaucggcuccgucucccucaccaucgccaccaucugcuuccucaugcagaucgccauccucgucaccaccgucacccuccacuucaagcaguacgagugcaacucccccuccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaagcccgagaccgaggucugguggaccuccaacuccaucgucgucuucugcggcaccuccggcaccuacggcaccggcuccuggcccgacggcgccgacaucaaccucaugcccaucuga

SEQ ID NO: 105773 - RNA, 1410 nt, Artificial Sequence; identical to SEQ ID NO: 105573
  derived and/or modified sequence opt2 from neuraminidase__InfluenzaA__AAY44778

SEQ ID NO: 105774 - RNA, 1410 nt, Artificial Sequence
  derived and/or modified sequence opt2 from neuraminidase__InfluenzaA__AAY44788
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaucuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105775 - RNA, 1410 nt, Artificial Sequence; identical to SEQ ID NO: 105649
  derived and/or modified sequence opt2 from neuraminidase__InfluenzaA__AAY44909

SEQ ID NO: 105776 - RNA, 1410 nt, Artificial Sequence; identical to SEQ ID NO: 105676
  derived and/or modified sequence opt2 from neuraminidase__InfluenzaA__AAY45649

SEQ ID NO: 105777 - RNA, 1410 nt, Artificial Sequence
  derived and/or modified sequence opt2 from neuraminidase__InfluenzaA__AAY46374
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccuacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgagcgcggcaacauguccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105778 - RNA, 1410 nt, Artificial Sequence
  derived and/or modified sequence opt2 from neuraminidase__InfluenzaA__AAY46384
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacgccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105779 - RNA, 1410 nt, Artificial Sequence
  derived and/or modified sequence opt2 from neuraminidase__InfluenzaA__AAY46394
augaaccccaaccagaagaucaucaccaucggcuccgucucccucaccaucgccaccaucugcuuccucaugcagaucgccauccucaucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucgaccucaugcccaucuga

SEQ ID NO: 105780 - RNA, 1410 nt, Artificial Sequence
  derived and/or modified sequence opt2 from neuraminidase__InfluenzaA__AAY46419
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccauccucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105781 - RNA, 1410 nt, Artificial Sequence
  derived and/or modified sequence opt2 from neuraminidase__InfluenzaA__AAY47016
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcaacgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacuccgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105782 - RNA, 1410 nt, Artificial Sequence
  derived and/or modified sequence opt2 from neuraminidase__InfluenzaA__AAY47055
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucuuccccaucuga

SEQ ID NO: 105783 - RNA, 1410 nt, Artificial Sequence
  derived and/or modified sequence opt2 from neuraminidase__InfluenzaA__AAY47078
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccacgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105784 - RNA, 1410 nt, Artificial Sequence
  derived and/or modified sequence opt2 from neuraminidase__InfluenzaA__AAY47088
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105785 - RNA, 1410 nt, Artificial Sequence; identical to SEQ ID NO: 105649
  derived and/or modified sequence opt2 from neuraminidase__InfluenzaA__AAY58319

SEQ ID NO: 105786 - RNA, 1392 nt, Artificial Sequence
  derived and/or modified sequence opt2 from neuraminidase__InfluenzaA__AAY59038
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccaccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105787 - RNA, 1410 nt, Artificial Sequence
  derived and/or modified sequence opt2 from neuraminidase__InfluenzaA__AAY64195
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggaggccgaggucugguggaccuccaacuccaucgucgucuucugcggcaccuccggcaccuacggcaccggcuccuggcccgacggcgccgacaucaaccucaugcccaucuga

SEQ ID NO: 105788 - RNA, 1410 nt, Artificial Sequence; identical to SEQ ID NO: 105647
  derived and/or modified sequence opt2 from neuraminidase__InfluenzaA__AAY64205

SEQ ID NO: 105789 - RNA, 1410 nt, Artificial Sequence; identical to SEQ ID NO: 105573
  derived and/or modified sequence opt2 from neuraminidase__InfluenzaA__AAY64215

SEQ ID NO: 105790 - RNA, 1410 nt, Artificial Sequence
  derived and/or modified sequence opt2 from neuraminidase__InfluenzaA__AAY64225
augaaccccaaccagaagaucaucaccaucggcuccgucucccucaccaucgccaccaucugcuuccucaugcagaucaccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaacgaggucugguggaccuccaacuccaucgucgucuucugcggcaccuccggcaccuacggcaccggcuccuggcccgacggcgccgacaucaaccucaugcccaucuga

SEQ ID NO: 105791 - RNA, 1410 nt, Artificial Sequence
  derived and/or modified sequence opt2 from neuraminidase__InfluenzaA__AAY64245
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccauccucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105792 - RNA, 1410 nt, Artificial Sequence; identical to SEQ ID NO: 105573
  derived and/or modified sequence opt2 from neuraminidase__InfluenzaA__AAY64255

SEQ ID NO: 105793 - RNA, 1410 nt, Artificial Sequence; identical to SEQ ID NO: 105791
  derived and/or modified sequence opt2 from neuraminidase__InfluenzaA__AAY64265

SEQ ID NO: 105794 - RNA, 1410 nt, Artificial Sequence; identical to SEQ ID NO: 105791
  derived and/or modified sequence opt2 from neuraminidase__InfluenzaA__AAY64285

SEQ ID NO: 105795 - RNA, 1410 nt, Artificial Sequence
  derived and/or modified sequence opt2 from neuraminidase__InfluenzaA__AAY64295
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucuccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105796 - RNA, 1410 nt, Artificial Sequence
  derived and/or modified sequence opt2 from neuraminidase__InfluenzaA__AAY64305
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgagcgcggcaacauguccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105797 - RNA, 1410 nt, Artificial Sequence; identical to SEQ ID NO: 105647
  derived and/or modified sequence opt2 from neuraminidase__InfluenzaA__AAY64335

SEQ ID NO: 105798 - RNA, 1410 nt, Artificial Sequence; identical to SEQ ID NO: 105662
  derived and/or modified sequence opt2 from neuraminidase__InfluenzaA__AAY64365

SEQ ID NO: 105799 - RNA, 1410 nt, Artificial Sequence
  derived and/or modified sequence opt2 from neuraminidase__InfluenzaA__AAY64385
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccauccucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105800 - RNA, 1410 nt, Artificial Sequence
  derived and/or modified sequence opt2 from neuraminidase__InfluenzaA__AAY64395
augaaccccaaccagaagaucaucaccaucggcuccgucucccucaucaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaacuccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105801 - RNA, 1410 nt, Artificial Sequence; identical to SEQ ID NO: 105796
  derived and/or modified sequence opt2 from neuraminidase__InfluenzaA__AAY64405

SEQ ID NO: 105802 - RNA, 1410 nt, Artificial Sequence; identical to SEQ ID NO: 105791
  derived and/or modified sequence opt2 from neuraminidase__InfluenzaA__AAY98040

SEQ ID NO: 105803 - RNA, 1410 nt, Artificial Sequence; identical to SEQ ID NO: 105791
  derived and/or modified sequence opt2 from neuraminidase__InfluenzaA__AAY98050

SEQ ID NO: 105804 - RNA, 1410 nt, Artificial Sequence; identical to SEQ ID NO: 105683
  derived and/or modified sequence opt2 from neuraminidase__InfluenzaA__AAY98060

SEQ ID NO: 105805 - RNA, 1410 nt, Artificial Sequence
  derived and/or modified sequence opt2 from neuraminidase__InfluenzaA__AAY98070
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaucuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105806 - RNA, 1410 nt, Artificial Sequence; identical to SEQ ID NO: 105691
  derived and/or modified sequence opt2 from neuraminidase__InfluenzaA__AAY98080

SEQ ID NO: 105807 - RNA, 1410 nt, Artificial Sequence
  derived and/or modified sequence opt2 from neuraminidase__InfluenzaA__AAY98090
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105808 - RNA, 1410 nt, Artificial Sequence; identical to SEQ ID NO: 105791
  derived and/or modified sequence opt2 from neuraminidase__InfluenzaA__AAY98100

SEQ ID NO: 105809 - RNA, 1410 nt, Artificial Sequence; identical to SEQ ID NO: 105791
  derived and/or modified sequence opt2 from neuraminidase__InfluenzaA__AAY98110

SEQ ID NO: 105810 - RNA, 1410 nt, Artificial Sequence; identical to SEQ ID NO: 105791
  derived and/or modified sequence opt2 from neuraminidase__InfluenzaA__AAY98120

SEQ ID NO: 105811 - RNA, 1410 nt, Artificial Sequence; identical to SEQ ID NO: 105791
  derived and/or modified sequence opt2 from neuraminidase__InfluenzaA__AAY98130

SEQ ID NO: 105812 - RNA, 1410 nt, Artificial Sequence; identical to SEQ ID NO: 105791
  derived and/or modified sequence opt2 from neuraminidase__InfluenzaA__AAY98150

SEQ ID NO: 105813 - RNA, 1410 nt, Artificial Sequence
  derived and/or modified sequence opt2 from neuraminidase__InfluenzaA__AAY98160
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccauccucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcaacgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccaacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105814 - RNA, 1410 nt, Artificial Sequence; identical to SEQ ID NO: 105791
  derived and/or modified sequence opt2 from neuraminidase__InfluenzaA__AAY98170

SEQ ID NO: 105815 - RNA, 1410 nt, Artificial Sequence; identical to SEQ ID NO: 105791
  derived and/or modified sequence opt2 from neuraminidase__InfluenzaA__AAY98180

SEQ ID NO: 105816 - RNA, 1410 nt, Artificial Sequence; identical to SEQ ID NO: 105791
  derived and/or modified sequence opt2 from neuraminidase__InfluenzaA__AAY98200

SEQ ID NO: 105817 - RNA, 1410 nt, Artificial Sequence; identical to SEQ ID NO: 105791
  derived and/or modified sequence opt2 from neuraminidase__InfluenzaA__AAY98210

SEQ ID NO: 105818 - RNA, 1410 nt, Artificial Sequence; identical to SEQ ID NO: 105796
  derived and/or modified sequence opt2 from neuraminidase__InfluenzaA__AAY98220

SEQ ID NO: 105819 - RNA, 1410 nt, Artificial Sequence; identical to SEQ ID NO: 105791
  derived and/or modified sequence opt2 from neuraminidase__InfluenzaA__AAY98230

SEQ ID NO: 105820 - RNA, 1410 nt, Artificial Sequence
  derived and/or modified sequence opt2 from neuraminidase__InfluenzaA__AAY98250
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccauccucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgaggacaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105821 - RNA, 1410 nt, Artificial Sequence; identical to SEQ ID NO: 105791
  derived and/or modified sequence opt2 from neuraminidase__InfluenzaA__AAY98322

SEQ ID NO: 105822 - RNA, 1410 nt, Artificial Sequence; identical to SEQ ID NO: 105796
  derived and/or modified sequence opt2 from neuraminidase__InfluenzaA__AAY98332

SEQ ID NO: 105823 - RNA, 1410 nt, Artificial Sequence; identical to SEQ ID NO: 105791
  derived and/or modified sequence opt2 from neuraminidase__InfluenzaA__AAY98342

SEQ ID NO: 105824 - RNA, 1410 nt, Artificial Sequence; identical to SEQ ID NO: 105791
  derived and/or modified sequence opt2 from neuraminidase__InfluenzaA__AAY98359

SEQ ID NO: 105825 - RNA, 1410 nt, Artificial Sequence; identical to SEQ ID NO: 105796
  derived and/or modified sequence opt2 from neuraminidase__InfluenzaA__AAY98369

SEQ ID NO: 105826 - RNA, 1410 nt, Artificial Sequence
  derived and/or modified sequence opt2 from neuraminidase__InfluenzaA__AAY98379
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcaacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105827 - RNA, 1410 nt, Artificial Sequence
  derived and/or modified sequence opt2 from neuraminidase__InfluenzaA__AAY98389
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105828 - RNA, 1410 nt, Artificial Sequence; identical to SEQ ID NO: 105791
  derived and/or modified sequence opt2 from neuraminidase__InfluenzaA__AAY98399

SEQ ID NO: 105829 - RNA, 1410 nt, Artificial Sequence; identical to SEQ ID NO: 105791
  derived and/or modified sequence opt2 from neuraminidase__InfluenzaA__AAY98409

SEQ ID NO: 105830 - RNA, 1410 nt, Artificial Sequence; identical to SEQ ID NO: 105791
  derived and/or modified sequence opt2 from neuraminidase__InfluenzaA__AAY98773

SEQ ID NO: 105831 - RNA, 1410 nt, Artificial Sequence
  derived and/or modified sequence opt2 from neuraminidase__InfluenzaA__AAZ32955
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaucguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105832 - RNA, 1344 nt, Artificial Sequence
  derived and/or modified sequence opt2 from neuraminidase__InfluenzaA__AAZ32957
augaaccccaaccagaagaucaucaccaucggcuccgucucccucaccaucuccaccaucugcuucuucaugcagaucgccauccucaucaccaccgucacccucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcaacgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105833 - RNA, 1344 nt, Artificial Sequence; identical to SEQ ID NO: 105832
  derived and/or modified sequence opt2 from neuraminidase__InfluenzaA__AAZ32958

SEQ ID NO: 105834 - RNA, 1344 nt, Artificial Sequence; identical to SEQ ID NO: 105832
  derived and/or modified sequence opt2 from neuraminidase__InfluenzaA__AAZ32959

SEQ ID NO: 105835 - RNA, 1410 nt, Artificial Sequence; identical to SEQ ID NO: 105796
  derived and/or modified sequence opt2 from neuraminidase__InfluenzaA__AAZ38465

SEQ ID NO: 105836 - RNA, 1410 nt, Artificial Sequence; identical to SEQ ID NO: 105796
  derived and/or modified sequence opt2 from neuraminidase__InfluenzaA__AAZ38476

SEQ ID NO: 105837 - RNA, 1410 nt, Artificial Sequence
  derived and/or modified sequence opt2 from neuraminidase__InfluenzaA__AAZ38487
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccauccucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccaacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105838 - RNA, 1410 nt, Artificial Sequence
  derived and/or modified sequence opt2 from neuraminidase__InfluenzaA__AAZ38509
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaacuccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105839 - RNA, 1410 nt, Artificial Sequence
  derived and/or modified sequence opt2 from neuraminidase__InfluenzaA__AAZ38586
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105840 - RNA, 1410 nt, Artificial Sequence; identical to SEQ ID NO: 105839
  derived and/or modified sequence opt2 from neuraminidase__InfluenzaA__AAZ38597

SEQ ID NO: 105841 - RNA, 1410 nt, Artificial Sequence
  derived and/or modified sequence opt2 from neuraminidase__InfluenzaA__AAZ38608
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaccaaccucaugcccaucuga

SEQ ID NO: 105842 - RNA, 1410 nt, Artificial Sequence
  derived and/or modified sequence opt2 from neuraminidase__InfluenzaA__AAZ38619
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105843 - RNA, 1410 nt, Artificial Sequence; identical to SEQ ID NO: 105839
  derived and/or modified sequence opt2 from neuraminidase__InfluenzaA__AAZ38641

SEQ ID NO: 105844 - RNA, 1410 nt, Artificial Sequence; identical to SEQ ID NO: 105839
  derived and/or modified sequence opt2 from neuraminidase__InfluenzaA__AAZ38653

SEQ ID NO: 105845 - RNA, 1410 nt, Artificial Sequence; identical to SEQ ID NO: 105630
  derived and/or modified sequence opt2 from neuraminidase__InfluenzaA__AAZ43386

SEQ ID NO: 105846 - RNA, 1410 nt, Artificial Sequence
  derived and/or modified sequence opt2 from neuraminidase__InfluenzaA__AAZ43397
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagcgcgagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105847 - RNA, 1410 nt, Artificial Sequence
  derived and/or modified sequence opt2 from neuraminidase__InfluenzaA__AAZ43408
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaugaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105848 - RNA, 1410 nt, Artificial Sequence
  derived and/or modified sequence opt2 from neuraminidase__InfluenzaA__AAZ74355
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggccaugcccugcgagcccgccaucaucgagcgcaacaccaccgagaccgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105849 - RNA, 1410 nt, Artificial Sequence
  derived and/or modified sequence opt2 from neuraminidase__InfluenzaA__AAZ74366
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgacaaggacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105850 - RNA, 1410 nt, Artificial Sequence
  derived and/or modified sequence opt2 from neuraminidase__InfluenzaA__AAZ74377
augaaccccaaccagaagaucaucaccaucggcuccgucucccucaccaucgccaccaucugcuuccucacccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccauccgcgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 105851 - RNA, 1410 nt, Artificial Sequence
  derived and/or modified sequence opt2 from neuraminidase__InfluenzaA__AAZ74400
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccucccucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgagcgcggcaacauguccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105852 - RNA, 1410 nt, Artificial Sequence; identical to SEQ ID NO: 105791
  derived and/or modified sequence opt2 from neuraminidase__InfluenzaA__AAZ74411

SEQ ID NO: 105853 - RNA, 1410 nt, Artificial Sequence
  derived and/or modified sequence opt2 from neuraminidase__InfluenzaA__AAZ74422
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccaagcucuccggcuccgcccagcacgucgaggagugcuccugcuacccccgcuaccccggcauccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105854 - RNA, 1410 nt, Artificial Sequence; identical to SEQ ID NO: 105839
  derived and/or modified sequence opt2 from neuraminidase__InfluenzaA__AAZ74444

SEQ ID NO: 105855 - RNA, 1410 nt, Artificial Sequence
  derived and/or modified sequence opt2 from neuraminidase__InfluenzaA__AAZ74455
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105856 - RNA, 1410 nt, Artificial Sequence; identical to SEQ ID NO: 105839
  derived and/or modified sequence opt2 from neuraminidase__InfluenzaA__AAZ74477

SEQ ID NO: 105857 - RNA, 1410 nt, Artificial Sequence; identical to SEQ ID NO: 105855
  derived and/or modified sequence opt2 from neuraminidase__InfluenzaA__AAZ74488

SEQ ID NO: 105858 - RNA, 1410 nt, Artificial Sequence
  derived and/or modified sequence opt2 from neuraminidase__InfluenzaA__AAZ74499
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccaagcucuccggcuccgcccagcacgucgaggagugcuccugcuacccccgcuaccccggcauccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105859 - RNA, 1410 nt, Artificial Sequence; identical to SEQ ID NO: 105855
  derived and/or modified sequence opt2 from neuraminidase__InfluenzaA__AAZ74510

SEQ ID NO: 105860 - RNA, 1410 nt, Artificial Sequence; identical to SEQ ID NO: 105858
  derived and/or modified sequence opt2 from neuraminidase__InfluenzaA__AAZ74521

SEQ ID NO: 105861 - RNA, 1410 nt, Artificial Sequence
  derived and/or modified sequence opt2 from neuraminidase__InfluenzaA__AAZ74532
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcaacgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 105862 - RNA, 1410 nt, Artificial Sequence; identical to SEQ ID NO: 105839
  derived and/or modified sequence opt2 from neuraminidase__InfluenzaA__AAZ74543

SEQ ID NO: 105863 - RNA, 1410 nt, Artificial Sequence; identical to SEQ ID NO: 105791
  derived and/or modified sequence opt2 from neuraminidase__InfluenzaA__AAZ74565

SEQ ID NO: 105864 - RNA, 1410 nt, Artificial Sequence; identical to SEQ ID NO: 105839
  derived and/or modified sequence opt2 from neuraminidase__InfluenzaA__AAZ74598

SEQ ID NO: 105865 - RNA, 1410 nt, Artificial Sequence
  derived and/or modified sequence opt2 from neuraminidase__InfluenzaA__AAZ74609
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaucaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucuccuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105866 - RNA, 1410 nt, Artificial Sequence; identical to SEQ ID NO: 105573
  derived and/or modified sequence opt2 from neuraminidase__InfluenzaA__AAZ74620

SEQ ID NO: 105867 - RNA, 1410 nt, Artificial Sequence; identical to SEQ ID NO: 105685
  derived and/or modified sequence opt2 from neuraminidase__InfluenzaA__AAZ79508

SEQ ID NO: 105868 - RNA, 1410 nt, Artificial Sequence
  derived and/or modified sequence opt2 from neuraminidase__InfluenzaA__AAZ79519
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccauccucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcuggucccgccccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105869 - RNA, 1410 nt, Artificial Sequence; identical to SEQ ID NO: 105649
  derived and/or modified sequence opt2 from neuraminidase__InfluenzaA__AAZ79530

SEQ ID NO: 105870 - RNA, 1410 nt, Artificial Sequence
  derived and/or modified sequence opt2 from neuraminidase__InfluenzaA__AAZ79552
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcaccccccaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 105871 - RNA, 1410 nt, Artificial Sequence; identical to SEQ ID NO: 105791
  derived and/or modified sequence opt2 from neuraminidase__InfluenzaA__AAZ79563

SEQ ID NO: 105872 - RNA, 1410 nt, Artificial Sequence; identical to SEQ ID NO: 105791
  derived and/or modified sequence opt2 from neuraminidase__InfluenzaA__AAZ79574

SEQ ID NO: 105873 - RNA, 1410 nt, Artificial Sequence; identical to SEQ ID NO: 105791
  derived and/or modified sequence opt2 from neuraminidase__InfluenzaA__AAZ79585

SEQ ID NO: 105874 - RNA, 1410 nt, Artificial Sequence; identical to SEQ ID NO: 105858
  derived and/or modified sequence opt2 from neuraminidase__InfluenzaA__AAZ79618

SEQ ID NO: 105875 - RNA, 1410 nt, Artificial Sequence; identical to SEQ ID NO: 105839
  derived and/or modified sequence opt2 from neuraminidase__InfluenzaA__AAZ79633

SEQ ID NO: 105876 - RNA, 1410 nt, Artificial Sequence; identical to SEQ ID NO: 105858
  derived and/or modified sequence opt2 from neuraminidase__InfluenzaA__AAZ79945

SEQ ID NO: 105877 - RNA, 1410 nt, Artificial Sequence; identical to SEQ ID NO: 105855
  derived and/or modified sequence opt2 from neuraminidase__InfluenzaA__AAZ79966

SEQ ID NO: 105878 - RNA, 1410 nt, Artificial Sequence; identical to SEQ ID NO: 105839
  derived and/or modified sequence opt2 from neuraminidase__InfluenzaA__AAZ79977

SEQ ID NO: 105879 - RNA, 1410 nt, Artificial Sequence; identical to SEQ ID NO: 105839
  derived and/or modified sequence opt2 from neuraminidase__InfluenzaA__AAZ79988

SEQ ID NO: 105880 - RNA, 1410 nt, Artificial Sequence
  derived and/or modified sequence opt2 from neuraminidase__InfluenzaA__AAZ79999
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105881 - RNA, 1410 nt, Artificial Sequence; identical to SEQ ID NO: 105627
  derived and/or modified sequence opt2 from neuraminidase__InfluenzaA__AAZ80010

SEQ ID NO: 105882 - RNA, 1410 nt, Artificial Sequence
  derived and/or modified sequence opt2 from neuraminidase__InfluenzaA__AAZ80021
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccaagcucuccggcuccgcccagcacgucgaggagugcuccugcuacccccgcuaccccggcauccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105883 - RNA, 1410 nt, Artificial Sequence
  derived and/or modified sequence opt2 from neuraminidase__InfluenzaA__AAZ83245
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 105884 - RNA, 1413 nt, Artificial Sequence
  derived and/or modified sequence opt2 from neuraminidase__InfluenzaA__AAZ83256
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcaucgacuccgacaccgccaacugguccuggcccgacggcgccgagcuccccuucaccaucgacaaguga

SEQ ID NO: 105885 - RNA, 1410 nt, Artificial Sequence; identical to SEQ ID NO: 105791
  derived and/or modified sequence opt2 from neuraminidase__InfluenzaA__AAZ83269

SEQ ID NO: 105886 - RNA, 1410 nt, Artificial Sequence; identical to SEQ ID NO: 105791
  derived and/or modified sequence opt2 from neuraminidase__InfluenzaA__AAZ83280

SEQ ID NO: 105887 - RNA, 1410 nt, Artificial Sequence; identical to SEQ ID NO: 105765
  derived and/or modified sequence opt2 from neuraminidase__InfluenzaA__AAZ83291

SEQ ID NO: 105888 - RNA, 1413 nt, Artificial Sequence
  derived and/or modified sequence opt2 from neuraminidase__InfluenzaA__AAZ83302
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaaggccuccgucacccucgccggcaacuccucccucugcuccaucuccggcugggccaucuacaccaaggacaacuccauccgcaucggcuccaagggcgacgucuucgucauccgcgagcccuucaucuccugcucccacuccgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 105889 - RNA, 1410 nt, Artificial Sequence
  derived and/or modified sequence opt2 from neuraminidase__InfluenzaA__AAZ83315
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccaacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgccuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105890 - RNA, 1410 nt, Artificial Sequence
  derived and/or modified sequence opt2 from neuraminidase__InfluenzaA__AAZ83326
augaaccccaaccagaagaucaucaccaucggcuccgucucccucaccaucgccaccaucugcuuccucaugcagaucgccauccucgucaccaccgucacccuccacuucaagcaguacgagugcgacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 105891 - RNA, 1410 nt, Artificial Sequence
  derived and/or modified sequence opt2 from neuraminidase__InfluenzaA__AAZ83374
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcaccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105892 - RNA, 1410 nt, Artificial Sequence; identical to SEQ ID NO: 105858
  derived and/or modified sequence opt2 from neuraminidase__InfluenzaA__AAZ83385

SEQ ID NO: 105893 - RNA, 1413 nt, Artificial Sequence
  derived and/or modified sequence opt2 from neuraminidase__InfluenzaA__AAZ85129
augaacaccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 105894 - RNA, 1410 nt, Artificial Sequence
  derived and/or modified sequence opt2 from neuraminidase__InfluenzaA__ABA06513
augaaccccaaccagaagaucaucaccaucggcuccgucucccucaccaucgccaccaucugcuuccucacccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 105895 - RNA, 1410 nt, Artificial Sequence; identical to SEQ ID NO: 105894
  derived and/or modified sequence opt2 from neuraminidase__InfluenzaA__ABA06545

SEQ ID NO: 105896 - RNA, 1413 nt, Artificial Sequence
  derived and/or modified sequence opt2 from neuraminidase__InfluenzaA__ABA08478
augaacaccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 105897 - RNA, 1410 nt, Artificial Sequence; identical to SEQ ID NO: 105894
  derived and/or modified sequence opt2 from neuraminidase__InfluenzaA__ABA08511

SEQ ID NO: 105898 - RNA, 1413 nt, Artificial Sequence
  derived and/or modified sequence opt2 from neuraminidase__InfluenzaA__ABA12699
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 105899 - RNA, 1413 nt, Artificial Sequence; identical to SEQ ID NO: 105898
  derived and/or modified sequence opt2 from neuraminidase__InfluenzaA__ABA12710

SEQ ID NO: 105900 - RNA, 1413 nt, Artificial Sequence
  derived and/or modified sequence opt2 from neuraminidase__InfluenzaA__ABA12721
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucggcaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgcccccgcgacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 105901 - RNA, 1413 nt, Artificial Sequence; identical to SEQ ID NO: 105898
  derived and/or modified sequence opt2 from neuraminidase__InfluenzaA__ABA12732

SEQ ID NO: 105902 - RNA, 1410 nt, Artificial Sequence; identical to SEQ ID NO: 105839
  derived and/or modified sequence opt2 from neuraminidase__InfluenzaA__ABA12743

SEQ ID NO: 105903 - RNA, 1410 nt, Artificial Sequence; identical to SEQ ID NO: 105855
  derived and/or modified sequence opt2 from neuraminidase__InfluenzaA__ABA12754

SEQ ID NO: 105904 - RNA, 1410 nt, Artificial Sequence; identical to SEQ ID NO: 105858
  derived and/or modified sequence opt2 from neuraminidase__InfluenzaA__ABA12765

SEQ ID NO: 105905 - RNA, 1410 nt, Artificial Sequence; identical to SEQ ID NO: 105630
  derived and/or modified sequence opt2 from neuraminidase__InfluenzaA__ABA12776

SEQ ID NO: 105906 - RNA, 1410 nt, Artificial Sequence; identical to SEQ ID NO: 105839
  derived and/or modified sequence opt2 from neuraminidase__InfluenzaA__ABA12786

SEQ ID NO: 105907 - RNA, 1410 nt, Artificial Sequence; identical to SEQ ID NO: 105858
  derived and/or modified sequence opt2 from neuraminidase__InfluenzaA__ABA18029

SEQ ID NO: 105908 - RNA, 1413 nt, Artificial Sequence
  derived and/or modified sequence opt2 from neuraminidase__InfluenzaA__ABA18040
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 105909 - RNA, 1410 nt, Artificial Sequence
  derived and/or modified sequence opt2 from neuraminidase__InfluenzaA__ABA18126
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacauguggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105910 - RNA, 1413 nt, Artificial Sequence; identical to SEQ ID NO: 105898
  derived and/or modified sequence opt2 from neuraminidase__InfluenzaA__ABA18148

SEQ ID NO: 105911 - RNA, 1410 nt, Artificial Sequence
  derived and/or modified sequence opt2 from neuraminidase__InfluenzaA__ABA18159
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccaagcucuccggcuccgcccagcacgucgaggagugcuccugcuacccccgcuaccccggcauccgcugcgucugccgcgacaacuggaagggcuccaaccgccccaucgucgacgucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105912 - RNA, 1410 nt, Artificial Sequence; identical to SEQ ID NO: 105839
  derived and/or modified sequence opt2 from neuraminidase__InfluenzaA__ABA26703

SEQ ID NO: 105913 - RNA, 1410 nt, Artificial Sequence; identical to SEQ ID NO: 105839
  derived and/or modified sequence opt2 from neuraminidase__InfluenzaA__ABA26714

SEQ ID NO: 105914 - RNA, 1410 nt, Artificial Sequence; identical to SEQ ID NO: 105839
  derived and/or modified sequence opt2 from neuraminidase__InfluenzaA__ABA26736

SEQ ID NO: 105915 - RNA, 1410 nt, Artificial Sequence; identical to SEQ ID NO: 105839
  derived and/or modified sequence opt2 from neuraminidase__InfluenzaA__ABA26747

SEQ ID NO: 105916 - RNA, 1410 nt, Artificial Sequence; identical to SEQ ID NO: 105839
  derived and/or modified sequence opt2 from neuraminidase__InfluenzaA__ABA26758

SEQ ID NO: 105917 - RNA, 1410 nt, Artificial Sequence; identical to SEQ ID NO: 105839
  derived and/or modified sequence opt2 from neuraminidase__InfluenzaA__ABA26769

SEQ ID NO: 105918 - RNA, 1410 nt, Artificial Sequence; identical to SEQ ID NO: 105839
  derived and/or modified sequence opt2 from neuraminidase__InfluenzaA__ABA26780

SEQ ID NO: 105919 - RNA, 1410 nt, Artificial Sequence; identical to SEQ ID NO: 105839
  derived and/or modified sequence opt2 from neuraminidase__InfluenzaA__ABA26791

SEQ ID NO: 105920 - RNA, 1410 nt, Artificial Sequence; identical to SEQ ID NO: 105839
  derived and/or modified sequence opt2 from neuraminidase__InfluenzaA__ABA26802

SEQ ID NO: 105921 - RNA, 1413 nt, Artificial Sequence
  derived and/or modified sequence opt2 from neuraminidase__InfluenzaA__ABA42250
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcgacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 105922 - RNA, 1413 nt, Artificial Sequence; identical to SEQ ID NO: 105908
  derived and/or modified sequence opt2 from neuraminidase__InfluenzaA__ABA42261

SEQ ID NO: 105923 - RNA, 1410 nt, Artificial Sequence
  derived and/or modified sequence opt2 from neuraminidase__InfluenzaA__ABA42272
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaagcuccgccucggcuacgagaccuucaaggucaucgagggcugguccaaccccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105924 - RNA, 1410 nt, Artificial Sequence; identical to SEQ ID NO: 105839
  derived and/or modified sequence opt2 from neuraminidase__InfluenzaA__ABA42294

SEQ ID NO: 105925 - RNA, 1410 nt, Artificial Sequence; identical to SEQ ID NO: 105666
  derived and/or modified sequence opt2 from neuraminidase__InfluenzaA__ABA42305

SEQ ID NO: 105926 - RNA, 1410 nt, Artificial Sequence; identical to SEQ ID NO: 105676
  derived and/or modified sequence opt2 from neuraminidase__InfluenzaA__ABA42316

SEQ ID NO: 105927 - RNA, 1413 nt, Artificial Sequence
  derived and/or modified sequence opt2 from neuraminidase__InfluenzaA__ABA42327
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 105928 - RNA, 1410 nt, Artificial Sequence; identical to SEQ ID NO: 105661
  derived and/or modified sequence opt2 from neuraminidase__InfluenzaA__ABA42338

SEQ ID NO: 105929 - RNA, 1410 nt, Artificial Sequence
  derived and/or modified sequence opt2 from neuraminidase__InfluenzaA__ABA42349
augaaccccaaccagaagaucaucaccaucggcuccgucucccucaccaucgccaccaucugcuuccucaugcagaucgccauccucgucaccaccgucacccuccacuucaagcaguacgagugcgacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggcaagcucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105930 - RNA, 1410 nt, Artificial Sequence; identical to SEQ ID NO: 105666
  derived and/or modified sequence opt2 from neuraminidase__InfluenzaA__ABA42360

SEQ ID NO: 105931 - RNA, 1410 nt, Artificial Sequence; identical to SEQ ID NO: 105661
  derived and/or modified sequence opt2 from neuraminidase__InfluenzaA__ABA42371

SEQ ID NO: 105932 - RNA, 1410 nt, Artificial Sequence; identical to SEQ ID NO: 105676
  derived and/or modified sequence opt2 from neuraminidase__InfluenzaA__ABA42382

SEQ ID NO: 105933 - RNA, 1410 nt, Artificial Sequence; identical to SEQ ID NO: 105661
  derived and/or modified sequence opt2 from neuraminidase__InfluenzaA__ABA42393

SEQ ID NO: 105934 - RNA, 1410 nt, Artificial Sequence
  derived and/or modified sequence opt2 from neuraminidase__InfluenzaA__ABA42404
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccuccccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105935 - RNA, 1410 nt, Artificial Sequence; identical to SEQ ID NO: 105676
  derived and/or modified sequence opt2 from neuraminidase__InfluenzaA__ABA42415

SEQ ID NO: 105936 - RNA, 1410 nt, Artificial Sequence; identical to SEQ ID NO: 105683
  derived and/or modified sequence opt2 from neuraminidase__InfluenzaA__ABA42446

SEQ ID NO: 105937 - RNA, 1410 nt, Artificial Sequence
  derived and/or modified sequence opt2 from neuraminidase__InfluenzaA__ABA42457
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgaguccaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105938 - RNA, 1410 nt, Artificial Sequence; identical to SEQ ID NO: 105683
  derived and/or modified sequence opt2 from neuraminidase__InfluenzaA__ABA42468

SEQ ID NO: 105939 - RNA, 1410 nt, Artificial Sequence
  derived and/or modified sequence opt2 from neuraminidase__InfluenzaA__ABA42479
augaaccccaaccagaagaucaucaccaucggcuccgucucccucaccaucgccaccaucugcuuccucaugcagaucgccauccucgucaccaccgucacccuccacuucaagcaguacgagugcgacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggacggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105940 - RNA, 1410 nt, Artificial Sequence
  derived and/or modified sequence opt2 from neuraminidase__InfluenzaA__ABA42490
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucaagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 105941 - RNA, 1410 nt, Artificial Sequence; identical to SEQ ID NO: 105683
  derived and/or modified sequence opt2 from neuraminidase__InfluenzaA__ABA42501

SEQ ID NO: 105942 - RNA, 1410 nt, Artificial Sequence
  derived and/or modified sequence opt2 from neuraminidase__InfluenzaA__ABA42512
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccccaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105943 - RNA, 1410 nt, Artificial Sequence; identical to SEQ ID NO: 105573
  derived and/or modified sequence opt2 from neuraminidase__InfluenzaA__ABA42523

SEQ ID NO: 105944 - RNA, 1410 nt, Artificial Sequence; identical to SEQ ID NO: 105573
  derived and/or modified sequence opt2 from neuraminidase__InfluenzaA__ABA42534

SEQ ID NO: 105945 - RNA, 1410 nt, Artificial Sequence; identical to SEQ ID NO: 105765
  derived and/or modified sequence opt2 from neuraminidase__InfluenzaA__ABA42545

SEQ ID NO: 105946 - RNA, 1410 nt, Artificial Sequence
  derived and/or modified sequence opt2 from neuraminidase__InfluenzaA__ABA42556
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggaggccgagguccucuggaccuccaacuccaucgucgucuucugcggcaccuccggcaccuacggcaccggcuccuggcccgacggcgccgacaucaaccucaugcccaucuga

SEQ ID NO: 105947 - RNA, 1410 nt, Artificial Sequence; identical to SEQ ID NO: 105573
  derived and/or modified sequence opt2 from neuraminidase__InfluenzaA__ABA42567

SEQ ID NO: 105948 - RNA, 1410 nt, Artificial Sequence
  derived and/or modified sequence opt2 from neuraminidase__InfluenzaA__ABA42931
augaaccccaaccagaagaucaucaccaucggcuccgucucccucaccaucgccaccaucugcucccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105949 - RNA, 1410 nt, Artificial Sequence; identical to SEQ ID NO: 105573
  derived and/or modified sequence opt2 from neuraminidase__InfluenzaA__ABA42942

SEQ ID NO: 105950 - RNA, 1410 nt, Artificial Sequence; identical to SEQ ID NO: 105573
  derived and/or modified sequence opt2 from neuraminidase__InfluenzaA__ABA42981

SEQ ID NO: 105951 - RNA, 1410 nt, Artificial Sequence; identical to SEQ ID NO: 105661
  derived and/or modified sequence opt2 from neuraminidase__InfluenzaA__ABA42992

SEQ ID NO: 105952 - RNA, 1413 nt, Artificial Sequence
  derived and/or modified sequence opt2 from neuraminidase__InfluenzaA__ABA43192
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucauccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucuccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 105953 - RNA, 1410 nt, Artificial Sequence; identical to SEQ ID NO: 105858
  derived and/or modified sequence opt2 from neuraminidase__InfluenzaA__ABA43203

SEQ ID NO: 105954 - RNA, 1410 nt, Artificial Sequence
  derived and/or modified sequence opt2 from neuraminidase__InfluenzaA__ABA43339
augaaccccaaccagaagaucaucaccaucggcuccgucucccucuccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105955 - RNA, 1410 nt, Artificial Sequence
  derived and/or modified sequence opt2 from neuraminidase__InfluenzaA__ABA54916
augaaccccaaccagaagaucaucaccaccggcuccaucugcauggucaucggcauggucucccucaugcuccagaucggcaacaucaucuccaucugggucucccacuccauccagaccggcacccagcaccgcgccgagcccugcaaccgcuccaucaucaacuacgagaacaacaccugggucaaccagaccuacgucaagaucuccaacaccaacuuccucaccgagaaggccgucgccuccguccgccucgucggcaacuccucccucugccccaucuccggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcgcccaggaguccgagugcgccugcgucaacggcuccugcuucaccgucaugaccgacggccccuccaacggccaggccuccuacaagaucuucaagaucgagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 105956 - RNA, 1413 nt, Artificial Sequence
  derived and/or modified sequence opt2 from neuraminidase__InfluenzaA__ABA87048
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuacaagaucuucaagaucgagaagggcaaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 105957 - RNA, 1413 nt, Artificial Sequence
  derived and/or modified sequence opt2 from neuraminidase__InfluenzaA__ABA87060
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcaccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcucccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 105958 - RNA, 1413 nt, Artificial Sequence
  derived and/or modified sequence opt2 from neuraminidase__InfluenzaA__ABA87083
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagaagaucaucaccuacaagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgucuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 105959 - RNA, 1413 nt, Artificial Sequence
  derived and/or modified sequence opt2 from neuraminidase__InfluenzaA__ABA87234
augaacuccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaucaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 105960 - RNA, 1410 nt, Artificial Sequence; identical to SEQ ID NO: 105894
  derived and/or modified sequence opt2 from neuraminidase__InfluenzaA__ABB02784

SEQ ID NO: 105961 - RNA, 1413 nt, Artificial Sequence; identical to SEQ ID NO: 105898
  derived and/or modified sequence opt2 from neuraminidase__InfluenzaA__ABB02795

SEQ ID NO: 105962 - RNA, 1413 nt, Artificial Sequence; identical to SEQ ID NO: 105898
  derived and/or modified sequence opt2 from neuraminidase__InfluenzaA__ABB02806

SEQ ID NO: 105963 - RNA, 1413 nt, Artificial Sequence
  derived and/or modified sequence opt2 from neuraminidase__InfluenzaA__ABB02817
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 105964 - RNA, 1413 nt, Artificial Sequence; identical to SEQ ID NO: 105963
  derived and/or modified sequence opt2 from neuraminidase__InfluenzaA__ABB02828

SEQ ID NO: 105965 - RNA, 1410 nt, Artificial Sequence
  derived and/or modified sequence opt2 from neuraminidase__InfluenzaA__ABB02839
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105966 - RNA, 1410 nt, Artificial Sequence
  derived and/or modified sequence opt2 from neuraminidase__InfluenzaA__ABB02850
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaucaccgacggcuccgccuccggcaaggccgacaccaagauccucuucaucgaggagggcaagaucguccacaccuccaagcucuccggcuccgcccagcacgucgaggagugcuccugcuacccccgcuaccccggcauccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccucugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105967 - RNA, 1410 nt, Artificial Sequence
  derived and/or modified sequence opt2 from neuraminidase__InfluenzaA__ABB02861
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucgaccucaugcccaucuga

SEQ ID NO: 105968 - RNA, 1410 nt, Artificial Sequence; identical to SEQ ID NO: 105765
  derived and/or modified sequence opt2 from neuraminidase__InfluenzaA__ABB02872

SEQ ID NO: 105969 - RNA, 1410 nt, Artificial Sequence; identical to SEQ ID NO: 105765
  derived and/or modified sequence opt2 from neuraminidase__InfluenzaA__ABB02883

SEQ ID NO: 105970 - RNA, 1410 nt, Artificial Sequence
  derived and/or modified sequence opt2 from neuraminidase__InfluenzaA__ABB02894
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagauggucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 105971 - RNA, 1410 nt, Artificial Sequence; identical to SEQ ID NO: 105573
  derived and/or modified sequence opt2 from neuraminidase__InfluenzaA__ABB02905

SEQ ID NO: 105972 - RNA, 1413 nt, Artificial Sequence
  derived and/or modified sequence opt2 from neuraminidase__InfluenzaA__ABB02916
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgcccccgcgacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 105973 - RNA, 1413 nt, Artificial Sequence
  derived and/or modified sequence opt2 from neuraminidase__InfluenzaA__ABB02927
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 105974 - RNA, 1413 nt, Artificial Sequence
  derived and/or modified sequence opt2 from neuraminidase__InfluenzaA__ABB02939
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccuggaugaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 105975 - RNA, 1410 nt, Artificial Sequence; identical to SEQ ID NO: 105890
  derived and/or modified sequence opt2 from neuraminidase__InfluenzaA__ABB02950

SEQ ID NO: 105976 - RNA, 1410 nt, Artificial Sequence; identical to SEQ ID NO: 105791
  derived and/or modified sequence opt2 from neuraminidase__InfluenzaA__ABB02961

SEQ ID NO: 105977 - RNA, 1410 nt, Artificial Sequence; identical to SEQ ID NO: 105791
  derived and/or modified sequence opt2 from neuraminidase__InfluenzaA__ABB02972

SEQ ID NO: 105978 - RNA, 1410 nt, Artificial Sequence; identical to SEQ ID NO: 105791
  derived and/or modified sequence opt2 from neuraminidase__InfluenzaA__ABB02983

SEQ ID NO: 105979 - RNA, 1410 nt, Artificial Sequence; identical to SEQ ID NO: 105791
  derived and/or modified sequence opt2 from neuraminidase__InfluenzaA__ABB02994

SEQ ID NO: 105980 - RNA, 1410 nt, Artificial Sequence; identical to SEQ ID NO: 105791
  derived and/or modified sequence opt2 from neuraminidase__InfluenzaA__ABB03005

SEQ ID NO: 105981 - RNA, 1410 nt, Artificial Sequence; identical to SEQ ID NO: 105796
  derived and/or modified sequence opt2 from neuraminidase__InfluenzaA__ABB03016

SEQ ID NO: 105982 - RNA, 1410 nt, Artificial Sequence; identical to SEQ ID NO: 105791
  derived and/or modified sequence opt2 from neuraminidase__InfluenzaA__ABB03027

SEQ ID NO: 105983 - RNA, 1410 nt, Artificial Sequence; identical to SEQ ID NO: 105796
  derived and/or modified sequence opt2 from neuraminidase__InfluenzaA__ABB03038

SEQ ID NO: 105984 - RNA, 1410 nt, Artificial Sequence; identical to SEQ ID NO: 105791
  derived and/or modified sequence opt2 from neuraminidase__InfluenzaA__ABB03049

SEQ ID NO: 105985 - RNA, 1410 nt, Artificial Sequence
  derived and/or modified sequence opt2 from neuraminidase__InfluenzaA__ABB03060
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcauccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105986 - RNA, 1410 nt, Artificial Sequence
  derived and/or modified sequence opt2 from neuraminidase__InfluenzaA__ABB03071
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105987 - RNA, 1410 nt, Artificial Sequence
  derived and/or modified sequence opt2 from neuraminidase__InfluenzaA__ABB03093
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacaucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 105988 - RNA, 1410 nt, Artificial Sequence; identical to SEQ ID NO: 105894
  derived and/or modified sequence opt2 from neuraminidase__InfluenzaA__ABB03104

SEQ ID NO: 105989 - RNA, 1410 nt, Artificial Sequence
  derived and/or modified sequence opt2 from neuraminidase__InfluenzaA__ABB03115
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaacgagguccucuggaccuccaacuccaucgucgucuucugcggcaccuccggcaccuacggcaccggcuccuggcccgacggcgccgacaucaaccucaugcccaucuga

SEQ ID NO: 105990 - RNA, 1413 nt, Artificial Sequence; identical to SEQ ID NO: 105898
  derived and/or modified sequence opt2 from neuraminidase__InfluenzaA__ABB03126

SEQ ID NO: 105991 - RNA, 1413 nt, Artificial Sequence
  derived and/or modified sequence opt2 from neuraminidase__InfluenzaA__ABB03148
augaaccccaaccagaagaucaucaccaucggcuccaucuccaucgccaucggcaccaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 105992 - RNA, 1410 nt, Artificial Sequence
  derived and/or modified sequence opt2 from neuraminidase__InfluenzaA__ABB04286
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagucccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105993 - RNA, 1410 nt, Artificial Sequence
  derived and/or modified sequence opt2 from neuraminidase__InfluenzaA__ABB04297
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucauccccugcgagcccaucaccaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105994 - RNA, 1410 nt, Artificial Sequence
  derived and/or modified sequence opt2 from neuraminidase__InfluenzaA__ABB04319
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccagaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105995 - RNA, 1410 nt, Artificial Sequence
  derived and/or modified sequence opt2 from neuraminidase__InfluenzaA__ABB04341
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccguccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaagaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105996 - RNA, 1410 nt, Artificial Sequence
  derived and/or modified sequence opt2 from neuraminidase__InfluenzaA__ABB04352
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105997 - RNA, 1410 nt, Artificial Sequence
  derived and/or modified sequence opt2 from neuraminidase__InfluenzaA__ABB04374
augaaccccaaccagaagaucaucaccaucggcuccgucucccucaccaucgccaccgucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacucccgcuacgucugcuccggccucgucggcgacaccccccgcaacaacgacaaguccuccaacuccaacugccgcaaccccaacaacgacaagggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagaccaaggucugguggaccuccaacuccaucgucgucuucugcggcaccuccggcaccuacggcaccggcuccuggcccgacggcgccgacaucaaccucaugcccaucuga

SEQ ID NO: 105998 - RNA, 1410 nt, Artificial Sequence
  derived and/or modified sequence opt2 from neuraminidase__InfluenzaA__ABB04931
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcaagcacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 105999 - RNA, 1410 nt, Artificial Sequence
  derived and/or modified sequence opt2 from neuraminidase__InfluenzaA__ABB04942
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106000 - RNA, 1410 nt, Artificial Sequence; identical to SEQ ID NO: 105996
  derived and/or modified sequence opt2 from neuraminidase__InfluenzaA__ABB04953

SEQ ID NO: 106001 - RNA, 1410 nt, Artificial Sequence; identical to SEQ ID NO: 105894
  derived and/or modified sequence opt2 from neuraminidase__InfluenzaA__ABB04975

SEQ ID NO: 106002 - RNA, 1410 nt, Artificial Sequence; identical to SEQ ID NO: 105692
  derived and/or modified sequence opt2 from neuraminidase__InfluenzaA__ABB04986

SEQ ID NO: 106003 - RNA, 1410 nt, Artificial Sequence
  derived and/or modified sequence opt2 from neuraminidase__InfluenzaA__ABB04997
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucguccaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaagcccaucuga

SEQ ID NO: 106004 - RNA, 1410 nt, Artificial Sequence; identical to SEQ ID NO: 105765
  derived and/or modified sequence opt2 from neuraminidase__InfluenzaA__ABB05008

SEQ ID NO: 106005 - RNA, 1410 nt, Artificial Sequence; identical to SEQ ID NO: 105573
  derived and/or modified sequence opt2 from neuraminidase__InfluenzaA__ABB05186

SEQ ID NO: 106006 - RNA, 1410 nt, Artificial Sequence; identical to SEQ ID NO: 105765
  derived and/or modified sequence opt2 from neuraminidase__InfluenzaA__ABB05219

SEQ ID NO: 106007 - RNA, 1410 nt, Artificial Sequence
  derived and/or modified sequence opt2 from neuraminidase__InfluenzaA__ABB46395
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaagcaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcacccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106008 - RNA, 1410 nt, Artificial Sequence; identical to SEQ ID NO: 105552
  derived and/or modified sequence opt2 from neuraminidase__InfluenzaA__ABB46417

SEQ ID NO: 106009 - RNA, 1410 nt, Artificial Sequence
  derived and/or modified sequence opt2 from neuraminidase__InfluenzaA__ABB46428
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106010 - RNA, 1410 nt, Artificial Sequence
  derived and/or modified sequence opt2 from neuraminidase__InfluenzaA__ABB46439
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcgccugcaccgucgucaugaccgacggcuccgccuccggcaaggccgacaccaagauccucuucaucgaggagcgccgcaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccuccaacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcgccuacggcaccggcuccuggcccgacggcgccgacaucaaccucaugcccaucuga

SEQ ID NO: 106011 - RNA, 1410 nt, Artificial Sequence; identical to SEQ ID NO: 105858
  derived and/or modified sequence opt2 from neuraminidase__InfluenzaA__ABB46450

SEQ ID NO: 106012 - RNA, 1410 nt, Artificial Sequence; identical to SEQ ID NO: 105839
  derived and/or modified sequence opt2 from neuraminidase__InfluenzaA__ABB46461

SEQ ID NO: 106013 - RNA, 1410 nt, Artificial Sequence
  derived and/or modified sequence opt2 from neuraminidase__InfluenzaA__ABB46550
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcgucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagucccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106014 - RNA, 1410 nt, Artificial Sequence
  derived and/or modified sequence opt2 from neuraminidase__InfluenzaA__ABB51955
augaaccccaaccagaagaucaucaccaucggcuccgucucccucaccaucuccaccaucugcuucuucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaucguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaaguucuuccgcacccaggaguccgagugcgucugcauccacggcaccugcaccgucgucaugaccgacggcuccgccucccgcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106015 - RNA, 1413 nt, Artificial Sequence
  derived and/or modified sequence opt2 from neuraminidase__InfluenzaA__ABB51956
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucaccgucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcccauccucggcacccaggaguccgagugggucugcgucaacggcuccugcuucaccaucaugaccgacgaccccuccuacgaggccgccuccuacaagaucuucaagaucgagcgcgagcgcgucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106016 - RNA, 1410 nt, Artificial Sequence
  derived and/or modified sequence opt2 from neuraminidase__InfluenzaA__ABB51957
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccgcgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagaucuuccgcacccagaaguucgagugcgucugcauccacuggaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106017 - RNA, 1413 nt, Artificial Sequence
  derived and/or modified sequence opt2 from neuraminidase__InfluenzaA__ABB51958
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucuccaucaacaacaccaacgucaucgccggcaaggacaagaccuccgucacccucgccggcaacuccucccucugccccauccgcggcugggccaucuacaccaagggcaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcucccgcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucggcaucggccgcaccaucuccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106018 - RNA, 1410 nt, Artificial Sequence
  derived and/or modified sequence opt2 from neuraminidase__InfluenzaA__ABB51959
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaacgaggagggcaagaucguccacaccuccaccugcuccggcuccgcccagcacgucgaggagugcuccugcuacucccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggccgcgccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106019 - RNA, 1413 nt, Artificial Sequence
  derived and/or modified sequence opt2 from neuraminidase__InfluenzaA__ABB51960
augaaccccaaccagaagaucaucaccaucggcuccaucuccaucgccaucggcaucaucucccucaugcuccagaucggcaacaucauccccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccgaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaagaucaccaaguccaucgagcucaacgcccccaacucccacuacgaggagugcuccugcuaccccgacaccggcaccgucaugugcgucugccgcgacuccuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacgaguacggcaacggcgacuggaucggccgcaccaaguccaaccgccuccgcaagggcuucgagaugaucugggaccccgacggcuggaccgacaccaacuccgacuucuccgucaagcaggacgucgucgccaucaccgacugguccggcuacuccggcuccuucguccagcaccccgagcucaccggccucgucugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106020 - RNA, 1410 nt, Artificial Sequence; identical to SEQ ID NO: 105855
  derived and/or modified sequence opt2 from neuraminidase__InfluenzaA__ABB53617

SEQ ID NO: 106021 - RNA, 1410 nt, Artificial Sequence
  derived and/or modified sequence opt2 from neuraminidase__InfluenzaA__ABB53721
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccuccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106022 - RNA, 1410 nt, Artificial Sequence
  derived and/or modified sequence opt2 from neuraminidase__InfluenzaA__ABB53754
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106023 - RNA, 1410 nt, Artificial Sequence; identical to SEQ ID NO: 105615
  derived and/or modified sequence opt2 from neuraminidase__InfluenzaA__ABB54517

SEQ ID NO: 106024 - RNA, 1410 nt, Artificial Sequence
  derived and/or modified sequence opt2 from neuraminidase__InfluenzaA__ABB59999
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucaccuucugcggcaccuccggcaccuacggcaccggcuccuggcccgacggcgccgacaucaaccucaugcccaucuga

SEQ ID NO: 106025 - RNA, 1410 nt, Artificial Sequence
  derived and/or modified sequence opt2 from neuraminidase__InfluenzaA__ABB60010
augaaccccaaccagaagaucaucaccaucggcuccgucucccucaccaucgccaccaucugcuuccucaugcagaucgccauccucgucaccaccgucacccuccacuucaagcaguacgaguacuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucucccgcuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106026 - RNA, 1410 nt, Artificial Sequence
  derived and/or modified sequence opt2 from neuraminidase__InfluenzaA__ABB77867
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106027 - RNA, 1410 nt, Artificial Sequence; identical to SEQ ID NO: 106026
  derived and/or modified sequence opt2 from neuraminidase__InfluenzaA__ABB79719

SEQ ID NO: 106028 - RNA, 1410 nt, Artificial Sequence
  derived and/or modified sequence opt2 from neuraminidase__InfluenzaA__ABB79734
augaaccccaaccagaagaucaucaccaucggcuccgucucccucacccucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106029 - RNA, 1410 nt, Artificial Sequence; identical to SEQ ID NO: 105999
  derived and/or modified sequence opt2 from neuraminidase__InfluenzaA__ABB79791

SEQ ID NO: 106030 - RNA, 1410 nt, Artificial Sequence
  derived and/or modified sequence opt2 from neuraminidase__InfluenzaA__ABB79802
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106031 - RNA, 1410 nt, Artificial Sequence
  derived and/or modified sequence opt2 from neuraminidase__InfluenzaA__ABB79813
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106032 - RNA, 1410 nt, Artificial Sequence; identical to SEQ ID NO: 106031
  derived and/or modified sequence opt2 from neuraminidase__InfluenzaA__ABB79960

SEQ ID NO: 106033 - RNA, 1410 nt, Artificial Sequence; identical to SEQ ID NO: 106031
  derived and/or modified sequence opt2 from neuraminidase__InfluenzaA__ABB79971

SEQ ID NO: 106034 - RNA, 1413 nt, Artificial Sequence
  derived and/or modified sequence opt2 from neuraminidase__InfluenzaA__ABB79982
augaacgccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106035 - RNA, 1413 nt, Artificial Sequence; identical to SEQ ID NO: 105963
  derived and/or modified sequence opt2 from neuraminidase__InfluenzaA__ABB79993

SEQ ID NO: 106036 - RNA, 1410 nt, Artificial Sequence
  derived and/or modified sequence opt2 from neuraminidase__InfluenzaA__ABB80004
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaccgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106037 - RNA, 1410 nt, Artificial Sequence; identical to SEQ ID NO: 106021
  derived and/or modified sequence opt2 from neuraminidase__InfluenzaA__ABB80015

SEQ ID NO: 106038 - RNA, 1410 nt, Artificial Sequence
  derived and/or modified sequence opt2 from neuraminidase__InfluenzaA__ABB80037
augaaccccaaccagaagaucaucaccaucggcuccgucucccucaccaucgccaccgucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaacaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucgaggacuacuccaucgacuccuccuacgucugcuccggccucgucggcgacaccccccgcaacaacgaccgcuccuccaacuccaacugccgcaaccccaacaacgagcgcggcaaccacggcgucaagggcugggccuucgacgacggcaacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106039 - RNA, 1413 nt, Artificial Sequence
  derived and/or modified sequence opt2 from neuraminidase__InfluenzaA__ABB80048
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacggcgacaccgccaacugguccuggcccgacggcgccgagcuccccuucaccaucgacaaguga

SEQ ID NO: 106040 - RNA, 1410 nt, Artificial Sequence
  derived and/or modified sequence opt2 from neuraminidase__InfluenzaA__ABB80084
augaaccccaaccagaagaucaucaccaucggcuccgucucccucaccaucgccaccaucugcuuccucaugcagaucgccauccucgucaccaccgucacccuccacuucaagcaguacgagugcaacucccccuccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106041 - RNA, 1410 nt, Artificial Sequence; identical to SEQ ID NO: 106026
  derived and/or modified sequence opt2 from neuraminidase__InfluenzaA__ABB80095

SEQ ID NO: 106042 - RNA, 1410 nt, Artificial Sequence; identical to SEQ ID NO: 106026
  derived and/or modified sequence opt2 from neuraminidase__InfluenzaA__ABB80162

SEQ ID NO: 106043 - RNA, 1410 nt, Artificial Sequence; identical to SEQ ID NO: 106026
  derived and/or modified sequence opt2 from neuraminidase__InfluenzaA__ABB80199

SEQ ID NO: 106044 - RNA, 1410 nt, Artificial Sequence
  derived and/or modified sequence opt2 from neuraminidase__InfluenzaA__ABB80210
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucggccucaugcccaucuga

SEQ ID NO: 106045 - RNA, 1410 nt, Artificial Sequence
  derived and/or modified sequence opt2 from neuraminidase__InfluenzaA__ABB80232
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucgccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcgacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106046 - RNA, 1410 nt, Artificial Sequence
  derived and/or modified sequence opt2 from neuraminidase__InfluenzaA__ABB80243
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagaaggagaacgaggucugguggaccuccaacuccaucgucgucuucugcggcaccuccggcaccuacggcaccggcuccuggcccgacggcgccgacaucaaccucaugcccaucuga

SEQ ID NO: 106047 - RNA, 1410 nt, Artificial Sequence
  derived and/or modified sequence opt2 from neuraminidase__InfluenzaA__ABB80254
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaucugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106048 - RNA, 1410 nt, Artificial Sequence; identical to SEQ ID NO: 105639
  derived and/or modified sequence opt2 from neuraminidase__InfluenzaA__ABB80495

SEQ ID NO: 106049 - RNA, 1410 nt, Artificial Sequence; identical to SEQ ID NO: 106026
  derived and/or modified sequence opt2 from neuraminidase__InfluenzaA__ABB80506

SEQ ID NO: 106050 - RNA, 1410 nt, Artificial Sequence; identical to SEQ ID NO: 106026
  derived and/or modified sequence opt2 from neuraminidase__InfluenzaA__ABB80517

SEQ ID NO: 106051 - RNA, 1410 nt, Artificial Sequence; identical to SEQ ID NO: 106026
  derived and/or modified sequence opt2 from neuraminidase__InfluenzaA__ABB80532

SEQ ID NO: 106052 - RNA, 1410 nt, Artificial Sequence
  derived and/or modified sequence opt2 from neuraminidase__InfluenzaA__ABB80644
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaacaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106053 - RNA, 1410 nt, Artificial Sequence
  derived and/or modified sequence opt2 from neuraminidase__InfluenzaA__ABB80664
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagguccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106054 - RNA, 1410 nt, Artificial Sequence
  derived and/or modified sequence opt2 from neuraminidase__InfluenzaA__ABB80675
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucgccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcgacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106055 - RNA, 1410 nt, Artificial Sequence
  derived and/or modified sequence opt2 from neuraminidase__InfluenzaA__ABB80685
augaaccccaaccagaagaucaucaccaucggcuccgucucccucaccaucgccaccaucugcuuccucaugcagaucgccauccucgucaucaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106056 - RNA, 1410 nt, Artificial Sequence; identical to SEQ ID NO: 106026
  derived and/or modified sequence opt2 from neuraminidase__InfluenzaA__ABB80696

SEQ ID NO: 106057 - RNA, 1410 nt, Artificial Sequence
  derived and/or modified sequence opt2 from neuraminidase__InfluenzaA__ABB80707
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106058 - RNA, 1410 nt, Artificial Sequence; identical to SEQ ID NO: 106026
  derived and/or modified sequence opt2 from neuraminidase__InfluenzaA__ABB80716

SEQ ID NO: 106059 - RNA, 1410 nt, Artificial Sequence
  derived and/or modified sequence opt2 from neuraminidase__InfluenzaA__ABB80725
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccgucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgccuucugcggcaccuccggcaccuacggcaccggcuccuggcccgacggcgccgacaucaaccucaugcccaucuga

SEQ ID NO: 106060 - RNA, 1410 nt, Artificial Sequence
  derived and/or modified sequence opt2 from neuraminidase__InfluenzaA__ABB80740
augaaccccaaccagaagaucaucaccaucggcuccgucucccucaccaucgccaccaucugcuuccucaugcagaucgccauccucgucaccaccgucacccuccacuucaagcaguacgagugcugcuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgccuucugcggcaccuccggcaccuacggcaccggcuccuggcccgacggcgccgacaucaaccucaugcccaucuga

SEQ ID NO: 106061 - RNA, 1410 nt, Artificial Sequence; identical to SEQ ID NO: 106026
  derived and/or modified sequence opt2 from neuraminidase__InfluenzaA__ABB80751

SEQ ID NO: 106062 - RNA, 1410 nt, Artificial Sequence; identical to SEQ ID NO: 105745
  derived and/or modified sequence opt2 from neuraminidase__InfluenzaA__ABB82186

SEQ ID NO: 106063 - RNA, 1413 nt, Artificial Sequence; identical to SEQ ID NO: 105908
  derived and/or modified sequence opt2 from neuraminidase__InfluenzaA__ABB82197

SEQ ID NO: 106064 - RNA, 1413 nt, Artificial Sequence; identical to SEQ ID NO: 105898
  derived and/or modified sequence opt2 from neuraminidase__InfluenzaA__ABB82208

SEQ ID NO: 106065 - RNA, 1413 nt, Artificial Sequence
  derived and/or modified sequence opt2 from neuraminidase__InfluenzaA__ABB82219
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucaucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcuccaaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacgccgccgacugguccuggcccgacggcgccgagcuccccuucaccaucgacaaguga

SEQ ID NO: 106066 - RNA, 1410 nt, Artificial Sequence
  derived and/or modified sequence opt2 from neuraminidase__InfluenzaA__ABB82230
augaaccccaaccagaagaucaucaccaucggcuccgucucccucaccaucgccaccgucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccaucgucgacaucaacgucaaggacuacuccaucgacucccgcuacgucugcuccggccucgucggcgacaccccccgcaacaacgaccgcuccuccaacuccaacugccgcaaccccaacaacgacaagggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106067 - RNA, 1410 nt, Artificial Sequence
  derived and/or modified sequence opt2 from neuraminidase__InfluenzaA__ABB83018
augaaccccaaccagaagaucaucaccaucggcuccgucucccucaccaucgccaccaucugcuuccucacccagaucgccauccucgucaccaccgucacccuccacuucaagcaguacggcugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 106068 - RNA, 1410 nt, Artificial Sequence; identical to SEQ ID NO: 106067
  derived and/or modified sequence opt2 from neuraminidase__InfluenzaA__ABB83029

SEQ ID NO: 106069 - RNA, 1410 nt, Artificial Sequence; identical to SEQ ID NO: 105894
  derived and/or modified sequence opt2 from neuraminidase__InfluenzaA__ABB83130

SEQ ID NO: 106070 - RNA, 1410 nt, Artificial Sequence
  derived and/or modified sequence opt2 from neuraminidase__InfluenzaA__ABB83141
augaaccccaaccagaagaucaucaccaucggcuccgucucccucaccaucgccaccaucugcuuccucucccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 106071 - RNA, 1410 nt, Artificial Sequence
  derived and/or modified sequence opt2 from neuraminidase__InfluenzaA__ABB86876
augaacaccaaccagcgcaucaucaccaucggcaccgucugccucaucgucggcaucaucucccuccuccuccagaucggcaacaucgucucccucuggaucucccacuccauccagaccggcggcaagaaccacuccgagaugugcaaccagaacgucaucaccuacgucaacaacaccugggucaaccgcaccuacgucaacaucuccaacaccaacaucgccaccguccaggacgucaccuccgucauccucgccggcaacuccucccucugcuccgucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaaggucgagaagggcaagaucaucaaguccaucgagcucgacgcccccaacuaccacuacgaggagugcuccugcuaccccgacaccggcaaggucaugugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucaacucccgcuccggcuucgagaugaucugggaccccaacggcuggaccggcaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucugggccuccggcuccuccaucuccuucugcggcgucgacuccgagaccaccuccugguccuggcccgacggcgccgaccuccccuucaccaucgacaaguga

SEQ ID NO: 106072 - RNA, 1410 nt, Artificial Sequence
  derived and/or modified sequence opt2 from neuraminidase__InfluenzaA__ABB86886
augaacaccaaccagcgcaucaucaccaucggcaccgccugccucgccaucggcaucgucucccuccuccuccagaucggcaacaucgucucccucuggaucucccacuccauccagaccgaggagaagaaccacuccgagaccugcucccagaacuucaucacccacgagaacaacaccugggucaaccagaccuacaucaacaucuccaacaccaacaacgucgucggccagggcgucaccuccaucaugcucgccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccgucuucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgacgcccccaacuaccacuacgaggaguccuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaaggaggucuccuuccgcuacggcaacggcgucuggaucggccgcaccaaguccaucuccucccgcuccggcuucgagaugaucugggaccccaacggcuggaccgagaccgacuccuccuucuccaucaagcaggacaucaucgcccucaccgacugguccggcuacuccggcuccuucguccagcaccccgagcucaccggcaugaacugcaucaagcccugcuucugggucgagcucauccgcggccagcccaaggaguccaccaucuggaccuccggcuccuccaucuccuucugcggcgucgacuccgagaccgccuccugguccuggcccgacggcgccgaccuccccuucaccaucgacaaguga

SEQ ID NO: 106073 - RNA, 1410 nt, Artificial Sequence
  derived and/or modified sequence opt2 from neuraminidase__InfluenzaA__ABB86898
augaaccccaaccagaagaucaucaccaucggcuccgucucccucacccucgccaccaucugcuuccucaugcagaucgccauccucgucaccaccgucacccuccacuucaagcagcaggagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccacgaccgcacccccuaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcucccgcuccggcuacuccggcaucuucuccgucgagggcaaguccugcaucaaccgcugcuucuacgucgagcucauccgcggccgcaaggaggagaccaaggucugguggaccuccaacuccaucgucgucuucugcggcaccuccggcaccuacggcaccggcuccuggcccgacggcgccgacaucaaccucaugcccaucuga

SEQ ID NO: 106074 - RNA, 1410 nt, Artificial Sequence
  derived and/or modified sequence opt2 from neuraminidase__InfluenzaA__ABB86906
augaacaccaaccagcgcaucaucaccaucggcaccgucugccucaucgucggcaucaucucccuccuccuccagaucggcaacaucgucucccucuggaucucccacuccauccagaccggcggcaagaaccacuccgagaugugcaaccagaacgucaucaccuacgucaacaacaccugggucaaccgcaccuacgucaacaucuccaacaccaacaucgccaccguccaggacgucaccuccgucauccucgccggcaacuccucccucugcuccgucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacgagaucuucaaggucgagaagggcaagaucaucaaguccaucgagcucgacgcccccaacuaccacuacgaggagugcuccugcuaccccgacaccggcaaggucaugugcgucugccgcgacaacuggcacgccuccaaccgccccugggucuccuucgaccagaaccucaacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagauggucugggaccccaacggcuggaccggcaccgacucccgcuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucugggccuccggcuccuccaucuccuucugcggcgucaacuccgagaccgccuccugguccuggcccgacggcgccgaccuccccuucaccaucgacaaguga

SEQ ID NO: 106075 - RNA, 1410 nt, Artificial Sequence
  derived and/or modified sequence opt2 from neuraminidase__InfluenzaA__ABB86916
augaaccccaaccagaagaucaucaccaucggcuccgucucccucaccaucgccaccaucugcuuccucacccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucuccuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 106076 - RNA, 1410 nt, Artificial Sequence
  derived and/or modified sequence opt2 from neuraminidase__InfluenzaA__ABB86928
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccaucgagggcaaguccugcaucaaccgcugcuucuacgucgagcucauccgcggccgcaaggaggagaccaaggucugguggaccuccaacuccaucgucgucuucugcggcaccuccggcaccuacggcaccggcuccuggcccgacggcgccgacaucaaccucaugcccaucuga

SEQ ID NO: 106077 - RNA, 1410 nt, Artificial Sequence
  derived and/or modified sequence opt2 from neuraminidase__InfluenzaA__ABB86936
augaacaccaaccagcgcaucaucaccaucggcaccgucugccucaucgucggcaucaucucccuccuccuccagaucggcaacaucgucucccucuggaucaaccacuccauccagaccgagggcaagaaccacuccgagaugugcaaccagaacgucaucaccuacgucaacaacaccugggucaaccgcaccuacgucaacaucuccaacaccaacaucgccaccguccaggacgucaccuccgucauccucgccggcaacuccucccucugccccgucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccguccgcgaccgcucccccuaccgcacccucauguccugccccaccggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaaggucgagaagggcaagaucaucaaguccaucgagcucgacgcccccaacuaccacuacgaggagugcuccugcuaccccgacaccggcaaggucaugugcgucugccgcgacaacuggcacgccuccaaccgccccuggaucuacuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucaacucccgcuccggcuucgagaugaucugggaccccaacggcuggaccggcaccgacuccuccuucuccaugaagcaggacauccucgccaccaccgacugguccggcuacuccggcuccuucguccagcaccccgagcucaccggcaugaacugcauccgccccugcuucugggucgagcucauccgcggccagcccaaggaguccaccaucugggccuccggcuccuccaucuccuucugcggcgucaacuccgagaccgccaacugguccuggcccgacggcgccgaccuccccuucaccaucgacaaguga

SEQ ID NO: 106078 - RNA, 1410 nt, Artificial Sequence
  derived and/or modified sequence opt2 from neuraminidase__InfluenzaA__ABB86947
augaacaccaaccagcgcaucaucaccaucggcaccgucugccucaucgucggcaucaucucccuccucucccagaucggcaacaucgucucccucuggaucauccacuccauccagaccggcggcaagaaccacuccgagaugugcaaccagaacgucaucaccuacgucaacaacaccugggucaaccgcaccuacaucaacaucuccaacaccaacaucgccaccgucaaggacgucaccuccgucauccucgccggcaacuccucccucugccccgucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaugaacggcuccugcuucaccguccucaccgacggccccuccaacggccaggccuccuacaagaucuucaaggucgagaagggcaagaucaucaaguccaucgagcucgacgcccccaacuaccacuacgaggagugcuccugcuaccccgacgccggcaaggucaugugcgucugccgcgacaacuggcacgccuccaaccgccccugggucuccuucgaccagaaccucgacuaccagaugggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucaacucccgcuccggcuucgagaugaucugggaccccaacggcuggaccggcaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucugggccuccggcuccuccaucuccuucugcggcgucaacuccgagaccgccuccugguccuggcccgacggcgccgaccuccccuucaccaucgacaaguga

SEQ ID NO: 106079 - RNA, 1410 nt, Artificial Sequence
  derived and/or modified sequence opt2 from neuraminidase__InfluenzaA__ABB86957
augaacaccaaccagcgcaucaucaccgucggcaccgucugccucaucgucggcaucgucucccuccuccuccagaucggcaacaucgucucccucuggaucucccacuccauccagaccggcgagaagaaccacuccgaggucugcaaccagaacaucaucaccuacgagaacaagaccugggucaaccagaccuacgucaacaucuccaacaccaacaucgccgagggccagggcgucaccuccaucaucauggccggcaacuccucccucugccccgucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggcuccgacaacgaggccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgaggcccccaacuaccacuacgaggagugcuccugcuaccccgacaccggcaaggucgucugcgucugccgcgacaacuggcacgccuccaaccgccccugggucuccuucaaccagaaccucgacuaccagaucggcuacaucugcuccggcgucuucggcgacaacccccgcuccaacgacggcaagggcaacugcggccccguccccuccaacggcgccaacggcgucaagggcuucuccuuccgcuacggcaacggcgucuggaucggccgcaccaaguccaucuucucccgcuccggcuucgagaugaucugggaccccaacggcuggaccgagaccgacuccuccuucuccaucaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucgacuccgagaccgccuccugguccuggcccgacggcgccgaccuccccuucaccaucgacaaguga

SEQ ID NO: 106080 - RNA, 1410 nt, Artificial Sequence
  derived and/or modified sequence opt2 from neuraminidase__InfluenzaA__ABB96333
augaaccccaaccagaagaucaucaccaucggcuccgucucccucaccaucgccaccaucugcuuccucaugcagaucgccauccucgucaccaccgucacccuccacuucaagcaguacgacugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgccuccuccuacgucugcuccggccucgucggcgacaccccccgcaagaacgaccgcuacuccuccuccuacugccgcaaccccaacaacgagaagggcaaccacggcgucaagggcugggccuucgacgacggcaacgacgucuggaugggccgcaccaucuccgacgagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106081 - RNA, 1410 nt, Artificial Sequence
  derived and/or modified sequence opt2 from neuraminidase__InfluenzaA__ABB96344
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggccgcugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagguccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgccuccuccuacgucugcuccggccucgucggcgacaccccccgcaagaacgaccgcuacuccuccuccuacugccgcaaccccaacaacgagaagggcaaccacggcgucaagggcugggccuucgacgacggcaacgacgucuggaugggccgcaccaucuccgacgagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106082 - RNA, 1410 nt, Artificial Sequence
  derived and/or modified sequence opt2 from neuraminidase__InfluenzaA__ABB96398
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaccugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgccuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106083 - RNA, 1410 nt, Artificial Sequence; identical to SEQ ID NO: 105894
  derived and/or modified sequence opt2 from neuraminidase__InfluenzaA__ABB96490

SEQ ID NO: 106084 - RNA, 1410 nt, Artificial Sequence
  derived and/or modified sequence opt2 from neuraminidase__InfluenzaA__ABB96501
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagucccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106085 - RNA, 1410 nt, Artificial Sequence
  derived and/or modified sequence opt2 from neuraminidase__InfluenzaA__ABB96534
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106086 - RNA, 1410 nt, Artificial Sequence
  derived and/or modified sequence opt2 from neuraminidase__InfluenzaA__ABC02237
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgccuucugcggcaccuccggcaccuacggcaccggcuccuggcccgacggcgccgacaucaaccucaugcccaucuga

SEQ ID NO: 106087 - RNA, 1410 nt, Artificial Sequence
  derived and/or modified sequence opt2 from neuraminidase__InfluenzaA__ABC02258
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccagaucaugcccugcgagcccaccaucaucgagcgcaacaucaccgagaucgucuaccucaccaacaucaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaagaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcgccggcuccuggcccgacggcgccgacaucaaccucaugcccaucuga

SEQ ID NO: 106088 - RNA, 1410 nt, Artificial Sequence
  derived and/or modified sequence opt2 from neuraminidase__InfluenzaA__ABC02269
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaccuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcacccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106089 - RNA, 1413 nt, Artificial Sequence
  derived and/or modified sequence opt2 from neuraminidase__InfluenzaA__ABC02280
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcucccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106090 - RNA, 1410 nt, Artificial Sequence; identical to SEQ ID NO: 106085
  derived and/or modified sequence opt2 from neuraminidase__InfluenzaA__ABC02302

SEQ ID NO: 106091 - RNA, 1410 nt, Artificial Sequence; identical to SEQ ID NO: 106082
  derived and/or modified sequence opt2 from neuraminidase__InfluenzaA__ABC02313

SEQ ID NO: 106092 - RNA, 1410 nt, Artificial Sequence; identical to SEQ ID NO: 106087
  derived and/or modified sequence opt2 from neuraminidase__InfluenzaA__ABC02324

SEQ ID NO: 106093 - RNA, 1410 nt, Artificial Sequence
  derived and/or modified sequence opt2 from neuraminidase__InfluenzaA__ABC02335
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucaaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106094 - RNA, 1410 nt, Artificial Sequence
  derived and/or modified sequence opt2 from neuraminidase__InfluenzaA__ABC39808
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcgaccacggcgucaagggcugggccuucgacgacggcaacgacgucuggaugggccgcaccaucuccgaggagucccgcuccggcuacgagaccuucaaggucaucggcggcugguccacccccaacuccaagucccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106095 - RNA, 1410 nt, Artificial Sequence; identical to SEQ ID NO: 105894
  derived and/or modified sequence opt2 from neuraminidase__InfluenzaA__ABC40525

SEQ ID NO: 106096 - RNA, 1413 nt, Artificial Sequence
  derived and/or modified sequence opt2 from neuraminidase__InfluenzaA__ABC40536
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaucaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106097 - RNA, 1410 nt, Artificial Sequence; identical to SEQ ID NO: 106088
  derived and/or modified sequence opt2 from neuraminidase__InfluenzaA__ABC40547

SEQ ID NO: 106098 - RNA, 1410 nt, Artificial Sequence
  derived and/or modified sequence opt2 from neuraminidase__InfluenzaA__ABC40558
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggccacgacaagaacgccaccgccuccuucaucuacgacggccgccucgucgacuccaucggcuccugguccaaguccauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccagaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacaucgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106099 - RNA, 1410 nt, Artificial Sequence
  derived and/or modified sequence opt2 from neuraminidase__InfluenzaA__ABC40611
augaaccccaaccagaagaucaucaccaucggcuccaucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106100 - RNA, 1410 nt, Artificial Sequence
  derived and/or modified sequence opt2 from neuraminidase__InfluenzaA__ABC40622
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcaacgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106101 - RNA, 1410 nt, Artificial Sequence
  derived and/or modified sequence opt2 from neuraminidase__InfluenzaA__ABC40634
augaaccccaaccagaagaucaucaccaucggcuccgucucccucaccaucgccaccaucugcuuccucacccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucgacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 106102 - RNA, 1410 nt, Artificial Sequence
  derived and/or modified sequence opt2 from neuraminidase__InfluenzaA__ABC40645
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106103 - RNA, 1410 nt, Artificial Sequence
  derived and/or modified sequence opt2 from neuraminidase__InfluenzaA__ABC41706
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106104 - RNA, 1413 nt, Artificial Sequence
  derived and/or modified sequence opt2 from neuraminidase__InfluenzaA__ABC41717
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccgucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 106105 - RNA, 1410 nt, Artificial Sequence
  derived and/or modified sequence opt2 from neuraminidase__InfluenzaA__ABC41728
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106106 - RNA, 1410 nt, Artificial Sequence; identical to SEQ ID NO: 106103
  derived and/or modified sequence opt2 from neuraminidase__InfluenzaA__ABC41742

SEQ ID NO: 106107 - RNA, 1410 nt, Artificial Sequence; identical to SEQ ID NO: 106103
  derived and/or modified sequence opt2 from neuraminidase__InfluenzaA__ABC41956

SEQ ID NO: 106108 - RNA, 1410 nt, Artificial Sequence; identical to SEQ ID NO: 106103
  derived and/or modified sequence opt2 from neuraminidase__InfluenzaA__ABC41967

SEQ ID NO: 106109 - RNA, 1410 nt, Artificial Sequence; identical to SEQ ID NO: 106103
  derived and/or modified sequence opt2 from neuraminidase__InfluenzaA__ABC42017

SEQ ID NO: 106110 - RNA, 1410 nt, Artificial Sequence; identical to SEQ ID NO: 106103
  derived and/or modified sequence opt2 from neuraminidase__InfluenzaA__ABC42117

SEQ ID NO: 106111 - RNA, 1410 nt, Artificial Sequence; identical to SEQ ID NO: 106103
  derived and/or modified sequence opt2 from neuraminidase__InfluenzaA__ABC42128

SEQ ID NO: 106112 - RNA, 1410 nt, Artificial Sequence; identical to SEQ ID NO: 106103
  derived and/or modified sequence opt2 from neuraminidase__InfluenzaA__ABC42139

SEQ ID NO: 106113 - RNA, 1410 nt, Artificial Sequence
  derived and/or modified sequence opt2 from neuraminidase__InfluenzaA__ABC42150
augaaccccaaccagaagaucaucaccaucggcuccgucucccucaccaucgccaccaucugcuuccucaugcagaucgccauccucgccaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccggcaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106114 - RNA, 1410 nt, Artificial Sequence; identical to SEQ ID NO: 106103
  derived and/or modified sequence opt2 from neuraminidase__InfluenzaA__ABC42161

SEQ ID NO: 106115 - RNA, 1410 nt, Artificial Sequence
  derived and/or modified sequence opt2 from neuraminidase__InfluenzaA__ABC42172
augaaccccaaccagaagaucaucaccaucggcuccgucucccucaccaucgccaccaucugcucccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106116 - RNA, 1410 nt, Artificial Sequence; identical to SEQ ID NO: 106103
  derived and/or modified sequence opt2 from neuraminidase__InfluenzaA__ABC42183

SEQ ID NO: 106117 - RNA, 1410 nt, Artificial Sequence; identical to SEQ ID NO: 106103
  derived and/or modified sequence opt2 from neuraminidase__InfluenzaA__ABC42195

SEQ ID NO: 106118 - RNA, 1410 nt, Artificial Sequence; identical to SEQ ID NO: 106103
  derived and/or modified sequence opt2 from neuraminidase__InfluenzaA__ABC42310

SEQ ID NO: 106119 - RNA, 1410 nt, Artificial Sequence; identical to SEQ ID NO: 106103
  derived and/or modified sequence opt2 from neuraminidase__InfluenzaA__ABC42321

SEQ ID NO: 106120 - RNA, 1410 nt, Artificial Sequence; identical to SEQ ID NO: 106103
  derived and/or modified sequence opt2 from neuraminidase__InfluenzaA__ABC42349

SEQ ID NO: 106121 - RNA, 1410 nt, Artificial Sequence; identical to SEQ ID NO: 106103
  derived and/or modified sequence opt2 from neuraminidase__InfluenzaA__ABC42464

SEQ ID NO: 106122 - RNA, 1410 nt, Artificial Sequence; identical to SEQ ID NO: 106103
  derived and/or modified sequence opt2 from neuraminidase__InfluenzaA__ABC42497

SEQ ID NO: 106123 - RNA, 1410 nt, Artificial Sequence; identical to SEQ ID NO: 106103
  derived and/or modified sequence opt2 from neuraminidase__InfluenzaA__ABC42508

SEQ ID NO: 106124 - RNA, 1410 nt, Artificial Sequence; identical to SEQ ID NO: 106103
  derived and/or modified sequence opt2 from neuraminidase__InfluenzaA__ABC42519

SEQ ID NO: 106125 - RNA, 1410 nt, Artificial Sequence; identical to SEQ ID NO: 106103
  derived and/or modified sequence opt2 from neuraminidase__InfluenzaA__ABC42530

SEQ ID NO: 106126 - RNA, 1410 nt, Artificial Sequence; identical to SEQ ID NO: 106103
  derived and/or modified sequence opt2 from neuraminidase__InfluenzaA__ABC42577

SEQ ID NO: 106127 - RNA, 1410 nt, Artificial Sequence; identical to SEQ ID NO: 106103
  derived and/or modified sequence opt2 from neuraminidase__InfluenzaA__ABC42588

SEQ ID NO: 106128 - RNA, 1410 nt, Artificial Sequence; identical to SEQ ID NO: 105839
  derived and/or modified sequence opt2 from neuraminidase__InfluenzaA__ABC42599

SEQ ID NO: 106129 - RNA, 1410 nt, Artificial Sequence; identical to SEQ ID NO: 105839
  derived and/or modified sequence opt2 from neuraminidase__InfluenzaA__ABC42610

SEQ ID NO: 106130 - RNA, 1410 nt, Artificial Sequence; identical to SEQ ID NO: 105839
  derived and/or modified sequence opt2 from neuraminidase__InfluenzaA__ABC42621

SEQ ID NO: 106131 - RNA, 1410 nt, Artificial Sequence; identical to SEQ ID NO: 105839
  derived and/or modified sequence opt2 from neuraminidase__InfluenzaA__ABC42632

SEQ ID NO: 106132 - RNA, 1410 nt, Artificial Sequence; identical to SEQ ID NO: 105839
  derived and/or modified sequence opt2 from neuraminidase__InfluenzaA__ABC42643

SEQ ID NO: 106133 - RNA, 1410 nt, Artificial Sequence; identical to SEQ ID NO: 105839
  derived and/or modified sequence opt2 from neuraminidase__InfluenzaA__ABC42654

SEQ ID NO: 106134 - RNA, 1410 nt, Artificial Sequence; identical to SEQ ID NO: 105839
  derived and/or modified sequence opt2 from neuraminidase__InfluenzaA__ABC42665

SEQ ID NO: 106135 - RNA, 1410 nt, Artificial Sequence; identical to SEQ ID NO: 105839
  derived and/or modified sequence opt2 from neuraminidase__InfluenzaA__ABC42676

SEQ ID NO: 106136 - RNA, 1410 nt, Artificial Sequence; identical to SEQ ID NO: 105839
  derived and/or modified sequence opt2 from neuraminidase__InfluenzaA__ABC42687

SEQ ID NO: 106137 - RNA, 1410 nt, Artificial Sequence; identical to SEQ ID NO: 105839
  derived and/or modified sequence opt2 from neuraminidase__InfluenzaA__ABC42698

SEQ ID NO: 106138 - RNA, 1410 nt, Artificial Sequence; identical to SEQ ID NO: 105839
  derived and/or modified sequence opt2 from neuraminidase__InfluenzaA__ABC42709

SEQ ID NO: 106139 - RNA, 1410 nt, Artificial Sequence; identical to SEQ ID NO: 105839
  derived and/or modified sequence opt2 from neuraminidase__InfluenzaA__ABC42720

SEQ ID NO: 106140 - RNA, 1410 nt, Artificial Sequence
  derived and/or modified sequence opt2 from neuraminidase__InfluenzaA__ABC42742
augaaccccaaccagaagaucaucaccaucggcuccgucucccucaccaucuccaccaucugcuucuucaugcagaucgccauccucaugaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgccgcaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106141 - RNA, 1410 nt, Artificial Sequence; identical to SEQ ID NO: 105839
  derived and/or modified sequence opt2 from neuraminidase__InfluenzaA__ABC42764

SEQ ID NO: 106142 - RNA, 1410 nt, Artificial Sequence; identical to SEQ ID NO: 105839
  derived and/or modified sequence opt2 from neuraminidase__InfluenzaA__ABC42775

SEQ ID NO: 106143 - RNA, 1410 nt, Artificial Sequence; identical to SEQ ID NO: 105839
  derived and/or modified sequence opt2 from neuraminidase__InfluenzaA__ABC42786

SEQ ID NO: 106144 - RNA, 1410 nt, Artificial Sequence; identical to SEQ ID NO: 105839
  derived and/or modified sequence opt2 from neuraminidase__InfluenzaA__ABC42797

SEQ ID NO: 106145 - RNA, 1410 nt, Artificial Sequence; identical to SEQ ID NO: 105839
  derived and/or modified sequence opt2 from neuraminidase__InfluenzaA__ABC42808

SEQ ID NO: 106146 - RNA, 1410 nt, Artificial Sequence; identical to SEQ ID NO: 105839
  derived and/or modified sequence opt2 from neuraminidase__InfluenzaA__ABC42819

SEQ ID NO: 106147 - RNA, 1410 nt, Artificial Sequence
  derived and/or modified sequence opt2 from neuraminidase__InfluenzaA__ABC42841
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccucccgcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106148 - RNA, 1410 nt, Artificial Sequence; identical to SEQ ID NO: 105839
  derived and/or modified sequence opt2 from neuraminidase__InfluenzaA__ABC42852

SEQ ID NO: 106149 - RNA, 1410 nt, Artificial Sequence; identical to SEQ ID NO: 105839
  derived and/or modified sequence opt2 from neuraminidase__InfluenzaA__ABC42863

SEQ ID NO: 106150 - RNA, 1410 nt, Artificial Sequence; identical to SEQ ID NO: 105678
  derived and/or modified sequence opt2 from neuraminidase__InfluenzaA__ABC42874

SEQ ID NO: 106151 - RNA, 1410 nt, Artificial Sequence; identical to SEQ ID NO: 105678
  derived and/or modified sequence opt2 from neuraminidase__InfluenzaA__ABC42885

SEQ ID NO: 106152 - RNA, 1410 nt, Artificial Sequence; identical to SEQ ID NO: 105678
  derived and/or modified sequence opt2 from neuraminidase__InfluenzaA__ABC42896

SEQ ID NO: 106153 - RNA, 1410 nt, Artificial Sequence; identical to SEQ ID NO: 106103
  derived and/or modified sequence opt2 from neuraminidase__InfluenzaA__ABC42914

SEQ ID NO: 106154 - RNA, 1410 nt, Artificial Sequence; identical to SEQ ID NO: 106103
  derived and/or modified sequence opt2 from neuraminidase__InfluenzaA__ABC42932

SEQ ID NO: 106155 - RNA, 1410 nt, Artificial Sequence
  derived and/or modified sequence opt2 from neuraminidase__InfluenzaA__ABC42943
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucggcuaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106156 - RNA, 1410 nt, Artificial Sequence; identical to SEQ ID NO: 106103
  derived and/or modified sequence opt2 from neuraminidase__InfluenzaA__ABC42954

SEQ ID NO: 106157 - RNA, 1410 nt, Artificial Sequence; identical to SEQ ID NO: 106103
  derived and/or modified sequence opt2 from neuraminidase__InfluenzaA__ABC42965

SEQ ID NO: 106158 - RNA, 1410 nt, Artificial Sequence
  derived and/or modified sequence opt2 from neuraminidase__InfluenzaA__ABC42976
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggccaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106159 - RNA, 1410 nt, Artificial Sequence; identical to SEQ ID NO: 106103
  derived and/or modified sequence opt2 from neuraminidase__InfluenzaA__ABC42987

SEQ ID NO: 106160 - RNA, 1410 nt, Artificial Sequence; identical to SEQ ID NO: 106103
  derived and/or modified sequence opt2 from neuraminidase__InfluenzaA__ABC42998

SEQ ID NO: 106161 - RNA, 1410 nt, Artificial Sequence; identical to SEQ ID NO: 106103
  derived and/or modified sequence opt2 from neuraminidase__InfluenzaA__ABC43009

SEQ ID NO: 106162 - RNA, 1410 nt, Artificial Sequence; identical to SEQ ID NO: 106103
  derived and/or modified sequence opt2 from neuraminidase__InfluenzaA__ABC43020

SEQ ID NO: 106163 - RNA, 1410 nt, Artificial Sequence
  derived and/or modified sequence opt2 from neuraminidase__InfluenzaA__ABC43042
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucauguccaucuga

SEQ ID NO: 106164 - RNA, 1410 nt, Artificial Sequence; identical to SEQ ID NO: 106103
  derived and/or modified sequence opt2 from neuraminidase__InfluenzaA__ABC43053

SEQ ID NO: 106165 - RNA, 1410 nt, Artificial Sequence
  derived and/or modified sequence opt2 from neuraminidase__InfluenzaA__ABC43064
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggagaagaccgaggucugguggaccuccaacuccaucgucgucuucugcggcaccuccggcaccuacggcaccggcuccuggcccgacggcgccgacaucaaccucaugcccaucuga

SEQ ID NO: 106166 - RNA, 1410 nt, Artificial Sequence; identical to SEQ ID NO: 106103
  derived and/or modified sequence opt2 from neuraminidase__InfluenzaA__ABC43075

SEQ ID NO: 106167 - RNA, 1410 nt, Artificial Sequence
  derived and/or modified sequence opt2 from neuraminidase__InfluenzaA__ABC43086
augaaccccaaccagaagaucaucaccaucggcuccgucucccucaucaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106168 - RNA, 1410 nt, Artificial Sequence; identical to SEQ ID NO: 106103
  derived and/or modified sequence opt2 from neuraminidase__InfluenzaA__ABC43097

SEQ ID NO: 106169 - RNA, 1410 nt, Artificial Sequence; identical to SEQ ID NO: 106103
  derived and/or modified sequence opt2 from neuraminidase__InfluenzaA__ABC43108

SEQ ID NO: 106170 - RNA, 1410 nt, Artificial Sequence; identical to SEQ ID NO: 106103
  derived and/or modified sequence opt2 from neuraminidase__InfluenzaA__ABC43119

SEQ ID NO: 106171 - RNA, 1410 nt, Artificial Sequence; identical to SEQ ID NO: 105839
  derived and/or modified sequence opt2 from neuraminidase__InfluenzaA__ABC43130

SEQ ID NO: 106172 - RNA, 1410 nt, Artificial Sequence; identical to SEQ ID NO: 105839
  derived and/or modified sequence opt2 from neuraminidase__InfluenzaA__ABC43141

SEQ ID NO: 106173 - RNA, 1410 nt, Artificial Sequence; identical to SEQ ID NO: 105839
  derived and/or modified sequence opt2 from neuraminidase__InfluenzaA__ABC43152

SEQ ID NO: 106174 - RNA, 1410 nt, Artificial Sequence; identical to SEQ ID NO: 105839
  derived and/or modified sequence opt2 from neuraminidase__InfluenzaA__ABC43163

SEQ ID NO: 106175 - RNA, 1410 nt, Artificial Sequence; identical to SEQ ID NO: 105839
  derived and/or modified sequence opt2 from neuraminidase__InfluenzaA__ABC43174

SEQ ID NO: 106176 - RNA, 1410 nt, Artificial Sequence
  derived and/or modified sequence opt2 from neuraminidase__InfluenzaA__ABC43185
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacacccgcauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106177 - RNA, 1410 nt, Artificial Sequence; identical to SEQ ID NO: 105839
  derived and/or modified sequence opt2 from neuraminidase__InfluenzaA__ABC43478

SEQ ID NO: 106178 - RNA, 1410 nt, Artificial Sequence; identical to SEQ ID NO: 105839
  derived and/or modified sequence opt2 from neuraminidase__InfluenzaA__ABC43489

SEQ ID NO: 106179 - RNA, 1410 nt, Artificial Sequence; identical to SEQ ID NO: 105839
  derived and/or modified sequence opt2 from neuraminidase__InfluenzaA__ABC43500

SEQ ID NO: 106180 - RNA, 1410 nt, Artificial Sequence
  derived and/or modified sequence opt2 from neuraminidase__InfluenzaA__ABC43511
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagaccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106181 - RNA, 1410 nt, Artificial Sequence; identical to SEQ ID NO: 105839
  derived and/or modified sequence opt2 from neuraminidase__InfluenzaA__ABC43522

SEQ ID NO: 106182 - RNA, 1410 nt, Artificial Sequence; identical to SEQ ID NO: 105839
  derived and/or modified sequence opt2 from neuraminidase__InfluenzaA__ABC43533

SEQ ID NO: 106183 - RNA, 1410 nt, Artificial Sequence; identical to SEQ ID NO: 105839
  derived and/or modified sequence opt2 from neuraminidase__InfluenzaA__ABC43544

SEQ ID NO: 106184 - RNA, 1410 nt, Artificial Sequence; identical to SEQ ID NO: 105839
  derived and/or modified sequence opt2 from neuraminidase__InfluenzaA__ABC43555

SEQ ID NO: 106185 - RNA, 1410 nt, Artificial Sequence; identical to SEQ ID NO: 106082
  derived and/or modified sequence opt2 from neuraminidase__InfluenzaA__ABC46557

SEQ ID NO: 106186 - RNA, 1410 nt, Artificial Sequence
  derived and/or modified sequence opt2 from neuraminidase__InfluenzaA__ABC46579
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106187 - RNA, 1410 nt, Artificial Sequence; identical to SEQ ID NO: 106026
  derived and/or modified sequence opt2 from neuraminidase__InfluenzaA__ABC50170

SEQ ID NO: 106188 - RNA, 1410 nt, Artificial Sequence; identical to SEQ ID NO: 106026
  derived and/or modified sequence opt2 from neuraminidase__InfluenzaA__ABC50181

SEQ ID NO: 106189 - RNA, 1410 nt, Artificial Sequence; identical to SEQ ID NO: 106026
  derived and/or modified sequence opt2 from neuraminidase__InfluenzaA__ABC50192

SEQ ID NO: 106190 - RNA, 1410 nt, Artificial Sequence; identical to SEQ ID NO: 105678
  derived and/or modified sequence opt2 from neuraminidase__InfluenzaA__ABC50203

SEQ ID NO: 106191 - RNA, 1410 nt, Artificial Sequence
  derived and/or modified sequence opt2 from neuraminidase__InfluenzaA__ABC50214
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucaucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaaccccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106192 - RNA, 1410 nt, Artificial Sequence; identical to SEQ ID NO: 105678
  derived and/or modified sequence opt2 from neuraminidase__InfluenzaA__ABC50225

SEQ ID NO: 106193 - RNA, 1410 nt, Artificial Sequence; identical to SEQ ID NO: 105678
  derived and/or modified sequence opt2 from neuraminidase__InfluenzaA__ABC50247

SEQ ID NO: 106194 - RNA, 1410 nt, Artificial Sequence
  derived and/or modified sequence opt2 from neuraminidase__InfluenzaA__ABC50258
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucaucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccaucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106195 - RNA, 1410 nt, Artificial Sequence; identical to SEQ ID NO: 105678
  derived and/or modified sequence opt2 from neuraminidase__InfluenzaA__ABC50280

SEQ ID NO: 106196 - RNA, 1410 nt, Artificial Sequence; identical to SEQ ID NO: 105678
  derived and/or modified sequence opt2 from neuraminidase__InfluenzaA__ABC50291

SEQ ID NO: 106197 - RNA, 1410 nt, Artificial Sequence
  derived and/or modified sequence opt2 from neuraminidase__InfluenzaA__ABC50302
augaaccccaaccagaagaucaucaccaucggcuccgucucccucaccaucgccaccaucugcuuccucaugcagaucgccauccucaucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106198 - RNA, 1410 nt, Artificial Sequence
  derived and/or modified sequence opt2 from neuraminidase__InfluenzaA__ABC50313
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106199 - RNA, 1410 nt, Artificial Sequence; identical to SEQ ID NO: 105678
  derived and/or modified sequence opt2 from neuraminidase__InfluenzaA__ABC50324

SEQ ID NO: 106200 - RNA, 1410 nt, Artificial Sequence; identical to SEQ ID NO: 105666
  derived and/or modified sequence opt2 from neuraminidase__InfluenzaA__ABC50335

SEQ ID NO: 106201 - RNA, 1410 nt, Artificial Sequence
  derived and/or modified sequence opt2 from neuraminidase__InfluenzaA__ABC50346
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucaucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106202 - RNA, 1410 nt, Artificial Sequence; identical to SEQ ID NO: 105678
  derived and/or modified sequence opt2 from neuraminidase__InfluenzaA__ABC50357

SEQ ID NO: 106203 - RNA, 1410 nt, Artificial Sequence; identical to SEQ ID NO: 105678
  derived and/or modified sequence opt2 from neuraminidase__InfluenzaA__ABC50368

SEQ ID NO: 106204 - RNA, 1410 nt, Artificial Sequence; identical to SEQ ID NO: 105678
  derived and/or modified sequence opt2 from neuraminidase__InfluenzaA__ABC50379

SEQ ID NO: 106205 - RNA, 1410 nt, Artificial Sequence; identical to SEQ ID NO: 105678
  derived and/or modified sequence opt2 from neuraminidase__InfluenzaA__ABC50390

SEQ ID NO: 106206 - RNA, 1410 nt, Artificial Sequence
  derived and/or modified sequence opt2 from neuraminidase__InfluenzaA__ABC50412
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106207 - RNA, 1410 nt, Artificial Sequence; identical to SEQ ID NO: 106206
  derived and/or modified sequence opt2 from neuraminidase__InfluenzaA__ABC50423

SEQ ID NO: 106208 - RNA, 1410 nt, Artificial Sequence; identical to SEQ ID NO: 105791
  derived and/or modified sequence opt2 from neuraminidase__InfluenzaA__ABC54671

SEQ ID NO: 106209 - RNA, 1410 nt, Artificial Sequence; identical to SEQ ID NO: 105923
  derived and/or modified sequence opt2 from neuraminidase__InfluenzaA__ABC54682

SEQ ID NO: 106210 - RNA, 1410 nt, Artificial Sequence; identical to SEQ ID NO: 106103
  derived and/or modified sequence opt2 from neuraminidase__InfluenzaA__ABC67322

SEQ ID NO: 106211 - RNA, 1410 nt, Artificial Sequence; identical to SEQ ID NO: 105678
  derived and/or modified sequence opt2 from neuraminidase__InfluenzaA__ABC67474

SEQ ID NO: 106212 - RNA, 1410 nt, Artificial Sequence; identical to SEQ ID NO: 106201
  derived and/or modified sequence opt2 from neuraminidase__InfluenzaA__ABC67546

SEQ ID NO: 106213 - RNA, 1410 nt, Artificial Sequence
  derived and/or modified sequence opt2 from neuraminidase__InfluenzaA__ABC67557
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106214 - RNA, 1410 nt, Artificial Sequence
  derived and/or modified sequence opt2 from neuraminidase__InfluenzaA__ABC67568
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccaacaucaaccucaugcccaucuga

SEQ ID NO: 106215 - RNA, 1410 nt, Artificial Sequence
  derived and/or modified sequence opt2 from neuraminidase__InfluenzaA__ABC67579
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106216 - RNA, 1410 nt, Artificial Sequence; identical to SEQ ID NO: 105839
  derived and/or modified sequence opt2 from neuraminidase__InfluenzaA__ABC67590

SEQ ID NO: 106217 - RNA, 1410 nt, Artificial Sequence; identical to SEQ ID NO: 105839
  derived and/or modified sequence opt2 from neuraminidase__InfluenzaA__ABC67601

SEQ ID NO: 106218 - RNA, 1410 nt, Artificial Sequence; identical to SEQ ID NO: 105678
  derived and/or modified sequence opt2 from neuraminidase__InfluenzaA__ABC67612

SEQ ID NO: 106219 - RNA, 1410 nt, Artificial Sequence; identical to SEQ ID NO: 105678
  derived and/or modified sequence opt2 from neuraminidase__InfluenzaA__ABC67623

SEQ ID NO: 106220 - RNA, 1410 nt, Artificial Sequence
  derived and/or modified sequence opt2 from neuraminidase__InfluenzaA__ABC67634
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106221 - RNA, 1410 nt, Artificial Sequence; identical to SEQ ID NO: 105678
  derived and/or modified sequence opt2 from neuraminidase__InfluenzaA__ABC67645

SEQ ID NO: 106222 - RNA, 1410 nt, Artificial Sequence; identical to SEQ ID NO: 105678
  derived and/or modified sequence opt2 from neuraminidase__InfluenzaA__ABC67656

SEQ ID NO: 106223 - RNA, 1410 nt, Artificial Sequence
  derived and/or modified sequence opt2 from neuraminidase__InfluenzaA__ABC67700
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaacuccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106224 - RNA, 1410 nt, Artificial Sequence
  derived and/or modified sequence opt2 from neuraminidase__InfluenzaA__ABC67711
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106225 - RNA, 1410 nt, Artificial Sequence
  derived and/or modified sequence opt2 from neuraminidase__InfluenzaA__ABC67736
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcgucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106226 - RNA, 1410 nt, Artificial Sequence
  derived and/or modified sequence opt2 from neuraminidase__InfluenzaA__ABC67809
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106227 - RNA, 1410 nt, Artificial Sequence; identical to SEQ ID NO: 106103
  derived and/or modified sequence opt2 from neuraminidase__InfluenzaA__ABC67820

SEQ ID NO: 106228 - RNA, 1410 nt, Artificial Sequence; identical to SEQ ID NO: 106082
  derived and/or modified sequence opt2 from neuraminidase__InfluenzaA__ABC67842

SEQ ID NO: 106229 - RNA, 1410 nt, Artificial Sequence; identical to SEQ ID NO: 105678
  derived and/or modified sequence opt2 from neuraminidase__InfluenzaA__ABC67853

SEQ ID NO: 106230 - RNA, 1410 nt, Artificial Sequence; identical to SEQ ID NO: 106082
  derived and/or modified sequence opt2 from neuraminidase__InfluenzaA__ABC67864

SEQ ID NO: 106231 - RNA, 1410 nt, Artificial Sequence; identical to SEQ ID NO: 106201
  derived and/or modified sequence opt2 from neuraminidase__InfluenzaA__ABC67886

SEQ ID NO: 106232 - RNA, 1410 nt, Artificial Sequence; identical to SEQ ID NO: 105678
  derived and/or modified sequence opt2 from neuraminidase__InfluenzaA__ABC67897

SEQ ID NO: 106233 - RNA, 1410 nt, Artificial Sequence; identical to SEQ ID NO: 105678
  derived and/or modified sequence opt2 from neuraminidase__InfluenzaA__ABC67970

SEQ ID NO: 106234 - RNA, 1410 nt, Artificial Sequence
  derived and/or modified sequence opt2 from neuraminidase__InfluenzaA__ABC67981
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccaguaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106235 - RNA, 1410 nt, Artificial Sequence
  derived and/or modified sequence opt2 from neuraminidase__InfluenzaA__ABC67992
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacaacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaucgaggucugguggaccuccaacuccaucgucgucuucugcggcaccuccggcaccuacggcaccggcuccuggcccgacggcgccgacaucaaccucaugcccaucuga

SEQ ID NO: 106236 - RNA, 1410 nt, Artificial Sequence; identical to SEQ ID NO: 106201
  derived and/or modified sequence opt2 from neuraminidase__InfluenzaA__ABC68003

SEQ ID NO: 106237 - RNA, 1410 nt, Artificial Sequence
  derived and/or modified sequence opt2 from neuraminidase__InfluenzaA__ABC68052
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaucgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106238 - RNA, 1410 nt, Artificial Sequence; identical to SEQ ID NO: 105678
  derived and/or modified sequence opt2 from neuraminidase__InfluenzaA__ABC68063

SEQ ID NO: 106239 - RNA, 1410 nt, Artificial Sequence; identical to SEQ ID NO: 105678
  derived and/or modified sequence opt2 from neuraminidase__InfluenzaA__ABC68074

SEQ ID NO: 106240 - RNA, 1410 nt, Artificial Sequence; identical to SEQ ID NO: 106224
  derived and/or modified sequence opt2 from neuraminidase__InfluenzaA__ABC68085

SEQ ID NO: 106241 - RNA, 1410 nt, Artificial Sequence
  derived and/or modified sequence opt2 from neuraminidase__InfluenzaA__ABC68096
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccacaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106242 - RNA, 1410 nt, Artificial Sequence
  derived and/or modified sequence opt2 from neuraminidase__InfluenzaA__ABC68225
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106243 - RNA, 1410 nt, Artificial Sequence; identical to SEQ ID NO: 106031
  derived and/or modified sequence opt2 from neuraminidase__InfluenzaA__ABC68236

SEQ ID NO: 106244 - RNA, 1350 nt, Artificial Sequence
  derived and/or modified sequence opt2 from neuraminidase__InfluenzaA__ABC72646
augaaccccaacaagaagaucaucaccaucggcuccaucugcauggucaccggcauggucucccucaugcuccagaucggcaaccucaucuccaucugggucucccacuccauccacaccggcaaccagcagaaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcucccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggacaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaccccccgccccaacgacggcaccggcuccugcggccccgucuccuccaacggcaccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106245 - RNA, 1410 nt, Artificial Sequence; identical to SEQ ID NO: 105607
  derived and/or modified sequence opt2 from neuraminidase__InfluenzaA__ABC84392

SEQ ID NO: 106246 - RNA, 1410 nt, Artificial Sequence; identical to SEQ ID NO: 106021
  derived and/or modified sequence opt2 from neuraminidase__InfluenzaA__ABC84403

SEQ ID NO: 106247 - RNA, 1410 nt, Artificial Sequence; identical to SEQ ID NO: 106026
  derived and/or modified sequence opt2 from neuraminidase__InfluenzaA__ABC84414

SEQ ID NO: 106248 - RNA, 1410 nt, Artificial Sequence
  derived and/or modified sequence opt2 from neuraminidase__InfluenzaA__ABC84425
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106249 - RNA, 1410 nt, Artificial Sequence; identical to SEQ ID NO: 105839
  derived and/or modified sequence opt2 from neuraminidase__InfluenzaA__ABC84436

SEQ ID NO: 106250 - RNA, 1410 nt, Artificial Sequence
  derived and/or modified sequence opt2 from neuraminidase__InfluenzaA__ABC84447
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucguccaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106251 - RNA, 1410 nt, Artificial Sequence; identical to SEQ ID NO: 106226
  derived and/or modified sequence opt2 from neuraminidase__InfluenzaA__ABC84501

SEQ ID NO: 106252 - RNA, 1410 nt, Artificial Sequence; identical to SEQ ID NO: 106226
  derived and/or modified sequence opt2 from neuraminidase__InfluenzaA__ABC84512

SEQ ID NO: 106253 - RNA, 1410 nt, Artificial Sequence
  derived and/or modified sequence opt2 from neuraminidase__InfluenzaA__ABC84523
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgccgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106254 - RNA, 1410 nt, Artificial Sequence
  derived and/or modified sequence opt2 from neuraminidase__InfluenzaA__ABC84545
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggcuccgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggaccacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106255 - RNA, 1410 nt, Artificial Sequence; identical to SEQ ID NO: 106242
  derived and/or modified sequence opt2 from neuraminidase__InfluenzaA__ABC84574

SEQ ID NO: 106256 - RNA, 1410 nt, Artificial Sequence; identical to SEQ ID NO: 106242
  derived and/or modified sequence opt2 from neuraminidase__InfluenzaA__ABC85757

SEQ ID NO: 106257 - RNA, 1410 nt, Artificial Sequence; identical to SEQ ID NO: 106253
  derived and/or modified sequence opt2 from neuraminidase__InfluenzaA__ABC85768

SEQ ID NO: 106258 - RNA, 1410 nt, Artificial Sequence; identical to SEQ ID NO: 106242
  derived and/or modified sequence opt2 from neuraminidase__InfluenzaA__ABC85779

SEQ ID NO: 106259 - RNA, 1410 nt, Artificial Sequence; identical to SEQ ID NO: 106242
  derived and/or modified sequence opt2 from neuraminidase__InfluenzaA__ABC85790

SEQ ID NO: 106260 - RNA, 1410 nt, Artificial Sequence; identical to SEQ ID NO: 106226
  derived and/or modified sequence opt2 from neuraminidase__InfluenzaA__ABC85801

SEQ ID NO: 106261 - RNA, 1410 nt, Artificial Sequence; identical to SEQ ID NO: 106226
  derived and/or modified sequence opt2 from neuraminidase__InfluenzaA__ABC85812

SEQ ID NO: 106262 - RNA, 1410 nt, Artificial Sequence; identical to SEQ ID NO: 106253
  derived and/or modified sequence opt2 from neuraminidase__InfluenzaA__ABC85823

SEQ ID NO: 106263 - RNA, 1410 nt, Artificial Sequence; identical to SEQ ID NO: 106225
  derived and/or modified sequence opt2 from neuraminidase__InfluenzaA__ABC85834

SEQ ID NO: 106264 - RNA, 1410 nt, Artificial Sequence; identical to SEQ ID NO: 106226
  derived and/or modified sequence opt2 from neuraminidase__InfluenzaA__ABC85845

SEQ ID NO: 106265 - RNA, 1410 nt, Artificial Sequence; identical to SEQ ID NO: 106253
  derived and/or modified sequence opt2 from neuraminidase__InfluenzaA__ABC85856

SEQ ID NO: 106266 - RNA, 1410 nt, Artificial Sequence; identical to SEQ ID NO: 106225
  derived and/or modified sequence opt2 from neuraminidase__InfluenzaA__ABC85867

SEQ ID NO: 106267 - RNA, 1410 nt, Artificial Sequence; identical to SEQ ID NO: 106224
  derived and/or modified sequence opt2 from neuraminidase__InfluenzaA__ABC85900

SEQ ID NO: 106268 - RNA, 1410 nt, Artificial Sequence
  derived and/or modified sequence opt2 from neuraminidase__InfluenzaA__ABC85911
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacauguggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106269 - RNA, 1410 nt, Artificial Sequence
  derived and/or modified sequence opt2 from neuraminidase__InfluenzaA__ABC85922
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaccaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgacuccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106270 - RNA, 1410 nt, Artificial Sequence; identical to SEQ ID NO: 105678
  derived and/or modified sequence opt2 from neuraminidase__InfluenzaA__ABC85933

SEQ ID NO: 106271 - RNA, 1410 nt, Artificial Sequence
  derived and/or modified sequence opt2 from neuraminidase__InfluenzaA__ABC85955
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccgcaugcccaucuga

SEQ ID NO: 106272 - RNA, 1410 nt, Artificial Sequence; identical to SEQ ID NO: 105678
  derived and/or modified sequence opt2 from neuraminidase__InfluenzaA__ABC85966

SEQ ID NO: 106273 - RNA, 1410 nt, Artificial Sequence; identical to SEQ ID NO: 105678
  derived and/or modified sequence opt2 from neuraminidase__InfluenzaA__ABC85977

SEQ ID NO: 106274 - RNA, 1410 nt, Artificial Sequence
  derived and/or modified sequence opt2 from neuraminidase__InfluenzaA__ABC85988
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaagggcaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106275 - RNA, 1410 nt, Artificial Sequence; identical to SEQ ID NO: 105839
  derived and/or modified sequence opt2 from neuraminidase__InfluenzaA__ABC85999

SEQ ID NO: 106276 - RNA, 1410 nt, Artificial Sequence; identical to SEQ ID NO: 105839
  derived and/or modified sequence opt2 from neuraminidase__InfluenzaA__ABC86010

SEQ ID NO: 106277 - RNA, 1410 nt, Artificial Sequence
  derived and/or modified sequence opt2 from neuraminidase__InfluenzaA__ABC86021
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 106278 - RNA, 1410 nt, Artificial Sequence; identical to SEQ ID NO: 106103
  derived and/or modified sequence opt2 from neuraminidase__InfluenzaA__ABC86127

SEQ ID NO: 106279 - RNA, 1410 nt, Artificial Sequence; identical to SEQ ID NO: 106186
  derived and/or modified sequence opt2 from neuraminidase__InfluenzaA__ABC86140

SEQ ID NO: 106280 - RNA, 1410 nt, Artificial Sequence; identical to SEQ ID NO: 105996
  derived and/or modified sequence opt2 from neuraminidase__InfluenzaA__ABC86151

SEQ ID NO: 106281 - RNA, 1413 nt, Artificial Sequence
  derived and/or modified sequence opt2 from neuraminidase__InfluenzaA__ABC86240
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagaagaucaucaccuacgagaaccgcaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 106282 - RNA, 1410 nt, Artificial Sequence
  derived and/or modified sequence opt2 from neuraminidase__InfluenzaA__ABC97377
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggcuccgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106283 - RNA, 1410 nt, Artificial Sequence; identical to SEQ ID NO: 105649
  derived and/or modified sequence opt2 from neuraminidase__InfluenzaA__ABD15452

SEQ ID NO: 106284 - RNA, 1410 nt, Artificial Sequence; identical to SEQ ID NO: 105737
  derived and/or modified sequence opt2 from neuraminidase__InfluenzaA__ABD15463

SEQ ID NO: 106285 - RNA, 1410 nt, Artificial Sequence; identical to SEQ ID NO: 105657
  derived and/or modified sequence opt2 from neuraminidase__InfluenzaA__ABD15474

SEQ ID NO: 106286 - RNA, 1410 nt, Artificial Sequence
  derived and/or modified sequence opt2 from neuraminidase__InfluenzaA__ABD15485
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccaacaucaaccucaugcccaucuga

SEQ ID NO: 106287 - RNA, 1410 nt, Artificial Sequence; identical to SEQ ID NO: 105737
  derived and/or modified sequence opt2 from neuraminidase__InfluenzaA__ABD15496

SEQ ID NO: 106288 - RNA, 1410 nt, Artificial Sequence; identical to SEQ ID NO: 105657
  derived and/or modified sequence opt2 from neuraminidase__InfluenzaA__ABD15507

SEQ ID NO: 106289 - RNA, 1413 nt, Artificial Sequence
  derived and/or modified sequence opt2 from neuraminidase__InfluenzaA__ABD15518
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcggcgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 106290 - RNA, 1410 nt, Artificial Sequence; identical to SEQ ID NO: 105839
  derived and/or modified sequence opt2 from neuraminidase__InfluenzaA__ABD15529

SEQ ID NO: 106291 - RNA, 1410 nt, Artificial Sequence; identical to SEQ ID NO: 106026
  derived and/or modified sequence opt2 from neuraminidase__InfluenzaA__ABD15551

SEQ ID NO: 106292 - RNA, 1410 nt, Artificial Sequence
  derived and/or modified sequence opt2 from neuraminidase__InfluenzaA__ABD15562
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccaucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106293 - RNA, 1410 nt, Artificial Sequence
  derived and/or modified sequence opt2 from neuraminidase__InfluenzaA__ABD15573
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106294 - RNA, 1410 nt, Artificial Sequence
  derived and/or modified sequence opt2 from neuraminidase__InfluenzaA__ABD15584
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacgagaacgacgucuggaugggccgcaccaucuccgagaaguuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucaucgucuucugcggcaccuccggcaccuacggcaccggcuccuggcccgacggcgccgacaucaaccucaugcccaucuga

SEQ ID NO: 106295 - RNA, 1410 nt, Artificial Sequence; identical to SEQ ID NO: 106026
  derived and/or modified sequence opt2 from neuraminidase__InfluenzaA__ABD15595

SEQ ID NO: 106296 - RNA, 1410 nt, Artificial Sequence; identical to SEQ ID NO: 106026
  derived and/or modified sequence opt2 from neuraminidase__InfluenzaA__ABD15606

SEQ ID NO: 106297 - RNA, 1410 nt, Artificial Sequence; identical to SEQ ID NO: 106026
  derived and/or modified sequence opt2 from neuraminidase__InfluenzaA__ABD15617

SEQ ID NO: 106298 - RNA, 1410 nt, Artificial Sequence; identical to SEQ ID NO: 106085
  derived and/or modified sequence opt2 from neuraminidase__InfluenzaA__ABD15639

SEQ ID NO: 106299 - RNA, 1410 nt, Artificial Sequence; identical to SEQ ID NO: 106242
  derived and/or modified sequence opt2 from neuraminidase__InfluenzaA__ABD15650

SEQ ID NO: 106300 - RNA, 1410 nt, Artificial Sequence; identical to SEQ ID NO: 105765
  derived and/or modified sequence opt2 from neuraminidase__InfluenzaA__ABD15661

SEQ ID NO: 106301 - RNA, 1410 nt, Artificial Sequence; identical to SEQ ID NO: 106242
  derived and/or modified sequence opt2 from neuraminidase__InfluenzaA__ABD15683

SEQ ID NO: 106302 - RNA, 1410 nt, Artificial Sequence; identical to SEQ ID NO: 105765
  derived and/or modified sequence opt2 from neuraminidase__InfluenzaA__ABD15694

SEQ ID NO: 106303 - RNA, 1410 nt, Artificial Sequence; identical to SEQ ID NO: 106242
  derived and/or modified sequence opt2 from neuraminidase__InfluenzaA__ABD15705

SEQ ID NO: 106304 - RNA, 1410 nt, Artificial Sequence; identical to SEQ ID NO: 106242
  derived and/or modified sequence opt2 from neuraminidase__InfluenzaA__ABD15727

SEQ ID NO: 106305 - RNA, 1410 nt, Artificial Sequence
  derived and/or modified sequence opt2 from neuraminidase__InfluenzaA__ABD15749
augaaccccaaccagaagaucaucaccaucggcuccgucucccucaccaucgccaccaucugcuuccucaugcagaucgccguccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106306 - RNA, 1410 nt, Artificial Sequence; identical to SEQ ID NO: 106305
  derived and/or modified sequence opt2 from neuraminidase__InfluenzaA__ABD15760

SEQ ID NO: 106307 - RNA, 1410 nt, Artificial Sequence; identical to SEQ ID NO: 106242
  derived and/or modified sequence opt2 from neuraminidase__InfluenzaA__ABD15771

SEQ ID NO: 106308 - RNA, 1410 nt, Artificial Sequence; identical to SEQ ID NO: 106242
  derived and/or modified sequence opt2 from neuraminidase__InfluenzaA__ABD15782

SEQ ID NO: 106309 - RNA, 1410 nt, Artificial Sequence; identical to SEQ ID NO: 106242
  derived and/or modified sequence opt2 from neuraminidase__InfluenzaA__ABD15793

SEQ ID NO: 106310 - RNA, 1410 nt, Artificial Sequence; identical to SEQ ID NO: 106226
  derived and/or modified sequence opt2 from neuraminidase__InfluenzaA__ABD16306

SEQ ID NO: 106311 - RNA, 1410 nt, Artificial Sequence
  derived and/or modified sequence opt2 from neuraminidase__InfluenzaA__ABD16317
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106312 - RNA, 1410 nt, Artificial Sequence; identical to SEQ ID NO: 106226
  derived and/or modified sequence opt2 from neuraminidase__InfluenzaA__ABD16328

SEQ ID NO: 106313 - RNA, 1410 nt, Artificial Sequence
  derived and/or modified sequence opt2 from neuraminidase__InfluenzaA__ABD16339
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106314 - RNA, 1410 nt, Artificial Sequence
  derived and/or modified sequence opt2 from neuraminidase__InfluenzaA__ABD16361
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggcaagcucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106315 - RNA, 1410 nt, Artificial Sequence; identical to SEQ ID NO: 106226
  derived and/or modified sequence opt2 from neuraminidase__InfluenzaA__ABD16475

SEQ ID NO: 106316 - RNA, 1410 nt, Artificial Sequence; identical to SEQ ID NO: 106226
  derived and/or modified sequence opt2 from neuraminidase__InfluenzaA__ABD16486

SEQ ID NO: 106317 - RNA, 1410 nt, Artificial Sequence; identical to SEQ ID NO: 106253
  derived and/or modified sequence opt2 from neuraminidase__InfluenzaA__ABD16497

SEQ ID NO: 106318 - RNA, 1410 nt, Artificial Sequence; identical to SEQ ID NO: 106226
  derived and/or modified sequence opt2 from neuraminidase__InfluenzaA__ABD16508

SEQ ID NO: 106319 - RNA, 1410 nt, Artificial Sequence
  derived and/or modified sequence opt2 from neuraminidase__InfluenzaA__ABD16519
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106320 - RNA, 1410 nt, Artificial Sequence
  derived and/or modified sequence opt2 from neuraminidase__InfluenzaA__ABD16530
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaagcgcugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106321 - RNA, 1410 nt, Artificial Sequence; identical to SEQ ID NO: 106103
  derived and/or modified sequence opt2 from neuraminidase__InfluenzaA__ABD16541

SEQ ID NO: 106322 - RNA, 1410 nt, Artificial Sequence; identical to SEQ ID NO: 106226
  derived and/or modified sequence opt2 from neuraminidase__InfluenzaA__ABD16552

SEQ ID NO: 106323 - RNA, 1410 nt, Artificial Sequence; identical to SEQ ID NO: 106225
  derived and/or modified sequence opt2 from neuraminidase__InfluenzaA__ABD16563

SEQ ID NO: 106324 - RNA, 1410 nt, Artificial Sequence
  derived and/or modified sequence opt2 from neuraminidase__InfluenzaA__ABD16574
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagaaggagacccgcgucugguggaccuccaacuccaucgucgucuucugcggcaccuccggcaccuacggcaccggcuccuggcccgacggcgccgacaucaaccucaugcccaucuga

SEQ ID NO: 106325 - RNA, 1410 nt, Artificial Sequence
  derived and/or modified sequence opt2 from neuraminidase__InfluenzaA__ABD16585
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106326 - RNA, 1410 nt, Artificial Sequence
  derived and/or modified sequence opt2 from neuraminidase__InfluenzaA__ABD16721
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccaagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccagaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccaagaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106327 - RNA, 1410 nt, Artificial Sequence; identical to SEQ ID NO: 105996
  derived and/or modified sequence opt2 from neuraminidase__InfluenzaA__ABD16732

SEQ ID NO: 106328 - RNA, 1410 nt, Artificial Sequence
  derived and/or modified sequence opt2 from neuraminidase__InfluenzaA__ABD16743
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaccuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcacccacggcgucaagggcugggccuucgacgacggcaacgacgucuggaugggccgcaccaucuccgaggacucccgcuccggcuacgagaccuucaaggucaucggcggcugguccacccccaacuccaagcuccagaugaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106329 - RNA, 1410 nt, Artificial Sequence; identical to SEQ ID NO: 106088
  derived and/or modified sequence opt2 from neuraminidase__InfluenzaA__ABD16754

SEQ ID NO: 106330 - RNA, 1410 nt, Artificial Sequence; identical to SEQ ID NO: 106186
  derived and/or modified sequence opt2 from neuraminidase__InfluenzaA__ABD16765

SEQ ID NO: 106331 - RNA, 1410 nt, Artificial Sequence; identical to SEQ ID NO: 105630
  derived and/or modified sequence opt2 from neuraminidase__InfluenzaA__ABD17326

SEQ ID NO: 106332 - RNA, 1410 nt, Artificial Sequence
  derived and/or modified sequence opt2 from neuraminidase__InfluenzaA__ABD38137
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucaucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagcccgaggucugguggaccuccaacuccaucgucgucuucugcggcacccccggcaccuacggcaccggcuccuggcccgacggcgccgacaucaaccucaugcccaucuga

SEQ ID NO: 106333 - RNA, 1413 nt, Artificial Sequence; identical to SEQ ID NO: 105898
  derived and/or modified sequence opt2 from neuraminidase__InfluenzaA__ABD60782

SEQ ID NO: 106334 - RNA, 1410 nt, Artificial Sequence
  derived and/or modified sequence opt2 from neuraminidase__InfluenzaA__ABD60793
augaaccccaaccagaagaucaucaccaucggcuccgucucccucaccaucgccaccaucugcuuccucaugcagaucgccauccucgucaccaccgucacccuccacuucaagcaguacgagugcgacucccccgucaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucgucuccuggucccagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgaccucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucaucgucuucugcggcaccuccggcaccuacggcaccggcuccuggcccgacggcgccgacaucaaccucaugcccaucuga

SEQ ID NO: 106335 - RNA, 1410 nt, Artificial Sequence; identical to SEQ ID NO: 106031
  derived and/or modified sequence opt2 from neuraminidase__InfluenzaA__ABD60804

SEQ ID NO: 106336 - RNA, 1410 nt, Artificial Sequence; identical to SEQ ID NO: 106224
  derived and/or modified sequence opt2 from neuraminidase__InfluenzaA__ABD60815

SEQ ID NO: 106337 - RNA, 1410 nt, Artificial Sequence; identical to SEQ ID NO: 106226
  derived and/or modified sequence opt2 from neuraminidase__InfluenzaA__ABD60826

SEQ ID NO: 106338 - RNA, 1410 nt, Artificial Sequence; identical to SEQ ID NO: 106305
  derived and/or modified sequence opt2 from neuraminidase__InfluenzaA__ABD60837

SEQ ID NO: 106339 - RNA, 1410 nt, Artificial Sequence
  derived and/or modified sequence opt2 from neuraminidase__InfluenzaA__ABD60848
augaaccccaaccagaagaucaucaccaucggcuccgucucccucaccaucgccaccaucugcuuccucaugcaggucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106340 - RNA, 1413 nt, Artificial Sequence
  derived and/or modified sequence opt2 from neuraminidase__InfluenzaA__ABD60881
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106341 - RNA, 1413 nt, Artificial Sequence
  derived and/or modified sequence opt2 from neuraminidase__InfluenzaA__ABD60892
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcgucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106342 - RNA, 1413 nt, Artificial Sequence; identical to SEQ ID NO: 106340
  derived and/or modified sequence opt2 from neuraminidase__InfluenzaA__ABD60903

SEQ ID NO: 106343 - RNA, 1413 nt, Artificial Sequence; identical to SEQ ID NO: 105927
  derived and/or modified sequence opt2 from neuraminidase__InfluenzaA__ABD60914

SEQ ID NO: 106344 - RNA, 1410 nt, Artificial Sequence
  derived and/or modified sequence opt2 from neuraminidase__InfluenzaA__ABD60925
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106345 - RNA, 1413 nt, Artificial Sequence
  derived and/or modified sequence opt2 from neuraminidase__InfluenzaA__ABD60947
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 106346 - RNA, 1410 nt, Artificial Sequence
  derived and/or modified sequence opt2 from neuraminidase__InfluenzaA__ABD61263
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcaugaagggcugggccuucgacgacggcaacgacgucuggaugggccgcaccaucuccgagaagcuccgcuccggcuacgagaccuucaaggucaucgagggcugguccaagcccaacuccaagcuccaggucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106347 - RNA, 1410 nt, Artificial Sequence; identical to SEQ ID NO: 105657
  derived and/or modified sequence opt2 from neuraminidase__InfluenzaA__ABD61274

SEQ ID NO: 106348 - RNA, 1410 nt, Artificial Sequence
  derived and/or modified sequence opt2 from neuraminidase__InfluenzaA__ABD61285
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcaacgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106349 - RNA, 1410 nt, Artificial Sequence; identical to SEQ ID NO: 106103
  derived and/or modified sequence opt2 from neuraminidase__InfluenzaA__ABD61296

SEQ ID NO: 106350 - RNA, 1410 nt, Artificial Sequence; identical to SEQ ID NO: 106224
  derived and/or modified sequence opt2 from neuraminidase__InfluenzaA__ABD61307

SEQ ID NO: 106351 - RNA, 1410 nt, Artificial Sequence; identical to SEQ ID NO: 106242
  derived and/or modified sequence opt2 from neuraminidase__InfluenzaA__ABD61318

SEQ ID NO: 106352 - RNA, 1410 nt, Artificial Sequence; identical to SEQ ID NO: 105573
  derived and/or modified sequence opt2 from neuraminidase__InfluenzaA__ABD61340

SEQ ID NO: 106353 - RNA, 1410 nt, Artificial Sequence; identical to SEQ ID NO: 105573
  derived and/or modified sequence opt2 from neuraminidase__InfluenzaA__ABD61351

SEQ ID NO: 106354 - RNA, 1410 nt, Artificial Sequence
  derived and/or modified sequence opt2 from neuraminidase__InfluenzaA__ABD61362
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucgaccucaugcccaucuga

SEQ ID NO: 106355 - RNA, 1410 nt, Artificial Sequence; identical to SEQ ID NO: 106305
  derived and/or modified sequence opt2 from neuraminidase__InfluenzaA__ABD61373

SEQ ID NO: 106356 - RNA, 1410 nt, Artificial Sequence
  derived and/or modified sequence opt2 from neuraminidase__InfluenzaA__ABD61384
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106357 - RNA, 1410 nt, Artificial Sequence; identical to SEQ ID NO: 106242
  derived and/or modified sequence opt2 from neuraminidase__InfluenzaA__ABD61395

SEQ ID NO: 106358 - RNA, 1410 nt, Artificial Sequence; identical to SEQ ID NO: 106339
  derived and/or modified sequence opt2 from neuraminidase__InfluenzaA__ABD61406

SEQ ID NO: 106359 - RNA, 1413 nt, Artificial Sequence; identical to SEQ ID NO: 106340
  derived and/or modified sequence opt2 from neuraminidase__InfluenzaA__ABD61521

SEQ ID NO: 106360 - RNA, 1410 nt, Artificial Sequence
  derived and/or modified sequence opt2 from neuraminidase__InfluenzaA__ABD61532
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccgagaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucucccucaugcccaucuga

SEQ ID NO: 106361 - RNA, 1413 nt, Artificial Sequence
  derived and/or modified sequence opt2 from neuraminidase__InfluenzaA__ABD61543
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcaacuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106362 - RNA, 1413 nt, Artificial Sequence; identical to SEQ ID NO: 106340
  derived and/or modified sequence opt2 from neuraminidase__InfluenzaA__ABD63066

SEQ ID NO: 106363 - RNA, 1410 nt, Artificial Sequence; identical to SEQ ID NO: 105765
  derived and/or modified sequence opt2 from neuraminidase__InfluenzaA__ABD77601

SEQ ID NO: 106364 - RNA, 1410 nt, Artificial Sequence
  derived and/or modified sequence opt2 from neuraminidase__InfluenzaA__ABD77612
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaugugccccaagcucgccgaguaccgcaacuggcucaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccaucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucaaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaggccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106365 - RNA, 1410 nt, Artificial Sequence
  derived and/or modified sequence opt2 from neuraminidase__InfluenzaA__ABD77634
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccaucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucaaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaggccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106366 - RNA, 1410 nt, Artificial Sequence; identical to SEQ ID NO: 106365
  derived and/or modified sequence opt2 from neuraminidase__InfluenzaA__ABD77645

SEQ ID NO: 106367 - RNA, 1410 nt, Artificial Sequence; identical to SEQ ID NO: 106365
  derived and/or modified sequence opt2 from neuraminidase__InfluenzaA__ABD77656

SEQ ID NO: 106368 - RNA, 1410 nt, Artificial Sequence; identical to SEQ ID NO: 105638
  derived and/or modified sequence opt2 from neuraminidase__InfluenzaA__ABD77700

SEQ ID NO: 106369 - RNA, 1413 nt, Artificial Sequence; identical to SEQ ID NO: 106340
  derived and/or modified sequence opt2 from neuraminidase__InfluenzaA__ABD77722

SEQ ID NO: 106370 - RNA, 1413 nt, Artificial Sequence; identical to SEQ ID NO: 106340
  derived and/or modified sequence opt2 from neuraminidase__InfluenzaA__ABD77733

SEQ ID NO: 106371 - RNA, 1410 nt, Artificial Sequence
  derived and/or modified sequence opt2 from neuraminidase__InfluenzaA__ABD77744
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106372 - RNA, 1410 nt, Artificial Sequence; identical to SEQ ID NO: 106365
  derived and/or modified sequence opt2 from neuraminidase__InfluenzaA__ABD77755

SEQ ID NO: 106373 - RNA, 1410 nt, Artificial Sequence; identical to SEQ ID NO: 106365
  derived and/or modified sequence opt2 from neuraminidase__InfluenzaA__ABD77766

SEQ ID NO: 106374 - RNA, 1410 nt, Artificial Sequence
  derived and/or modified sequence opt2 from neuraminidase__InfluenzaA__ABD77777
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcccugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106375 - RNA, 1410 nt, Artificial Sequence; identical to SEQ ID NO: 106374
  derived and/or modified sequence opt2 from neuraminidase__InfluenzaA__ABD77788

SEQ ID NO: 106376 - RNA, 1362 nt, Artificial Sequence
  derived and/or modified sequence opt2 from neuraminidase__InfluenzaA__ABD77799
augaaccccaaccagaagaucaucaccaucggcuccaucugcauggucgucggcaucaucucccucauccuccagaucggcaacaucaucuccaucuggaucucccacuccauccagaccggcaaccagaaccacaccggcaucugcaaccagggcaucaucaccuacaacgucgucgccggccaggacuccaccuccgucauccucaccggcaacuccucccucugccccauccgcggcugggccauccacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcaccugcgucaacggcuccugcuucaccaucaugaccgacggccccuccaacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaccggcuccugcggccccgucuccgccgacggcgccaacggcgucaagggcuucuccuaccgcuacggcaacggcgucuggaucggccgcaccaaguccgacuccucccgccacggcuucgagaugaucugggaccccaacggcuggaccgagaccgacucccgcuucuccguccgccaggacgucgucgccaugaccgaccgcuccggcuacuccggcuccuucguccagcaccccgagcucaccggccucgacugcaugcgccccugcuucugggucgagcucauccgcggccgccccgaggaggagaccaucuggaccuccggcuccaucaucuccuucugcggcgucaacuccgacaccgucgacugguccuggcccgacggcgccgagcuccccuucaccaucgacaaguga

SEQ ID NO: 106377 - RNA, 1410 nt, Artificial Sequence
  derived and/or modified sequence opt2 from neuraminidase__InfluenzaA__ABD77810
augaaccccaaccagaagaucaucaccaucggcuccaucugcauggucgucggcaucaucucccucauccuccagaucggcaacaucgucuccaucuggaucucccacuccauccagaccggcaaccagaaccacaccggcaccugcaaccaguccaucaucaccuacaagaacuccaccugggucaaccagaccuacgucaacaucuccaacaccaacgucgucgccggcaaggacaccaccuccgucauccucgccggcaacuccucccucugccccauccgcggcugggccaucuacuccaaggacaacggcguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaaggagauccuccgcacccaggaguccgagugcgucugcgucaacggcuccugcuucaccaucaugaccgacggccccuccggcggccccgccuccuacaagaucuucaagaucgagaagggcaaggucaccaaguccaucgagcucgacgcccccaacucccacuacgaggagugcuccugcuaccccgacaccuccaaggucaugugcgucugccgcgacaacuggcacggcuccaaccgccccugggucuccuucgaccagaaccucgacuaccagaugggcuacaucugcuccggcgucuucggcgacaacccccgccccaaggacggcaagggcuccugcggccccgucuacgucgacggcgccaacggcgucaagggcuucuccuaccgcuacggcaacggcgucuggaucggccgcaccaaguccaacuccucccgccagggcuucgagaugaucugggaccccaacggcuggaccgagaccgacuccaacuucuucaccaagcaggacgucgucgccgucaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 106378 - RNA, 1410 nt, Artificial Sequence
  derived and/or modified sequence opt2 from neuraminidase__InfluenzaA__ABD77832
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106379 - RNA, 1410 nt, Artificial Sequence
  derived and/or modified sequence opt2 from neuraminidase__InfluenzaA__ABD77876
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106380 - RNA, 1410 nt, Artificial Sequence; identical to SEQ ID NO: 105638
  derived and/or modified sequence opt2 from neuraminidase__InfluenzaA__ABD77887

SEQ ID NO: 106381 - RNA, 1410 nt, Artificial Sequence
  derived and/or modified sequence opt2 from neuraminidase__InfluenzaA__ABD77898
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcuccgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106382 - RNA, 1410 nt, Artificial Sequence
  derived and/or modified sequence opt2 from neuraminidase__InfluenzaA__ABD77909
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaacuccuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106383 - RNA, 1413 nt, Artificial Sequence; identical to SEQ ID NO: 106340
  derived and/or modified sequence opt2 from neuraminidase__InfluenzaA__ABD77920

SEQ ID NO: 106384 - RNA, 1413 nt, Artificial Sequence; identical to SEQ ID NO: 106340
  derived and/or modified sequence opt2 from neuraminidase__InfluenzaA__ABD77931

SEQ ID NO: 106385 - RNA, 1413 nt, Artificial Sequence; identical to SEQ ID NO: 106340
  derived and/or modified sequence opt2 from neuraminidase__InfluenzaA__ABD77942

SEQ ID NO: 106386 - RNA, 1413 nt, Artificial Sequence
  derived and/or modified sequence opt2 from neuraminidase__InfluenzaA__ABD77953
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuuccucgucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106387 - RNA, 1413 nt, Artificial Sequence
  derived and/or modified sequence opt2 from neuraminidase__InfluenzaA__ABD77964
augaaccccaaccagaagaucaucaccaucggcuccaucuccaucgccaucggcaucaucucccucaugcuccagaucggcaacaucaucuccaucugggccucccacuccauccagacccgcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106388 - RNA, 1413 nt, Artificial Sequence; identical to SEQ ID NO: 106340
  derived and/or modified sequence opt2 from neuraminidase__InfluenzaA__ABD77975

SEQ ID NO: 106389 - RNA, 1413 nt, Artificial Sequence; identical to SEQ ID NO: 106340
  derived and/or modified sequence opt2 from neuraminidase__InfluenzaA__ABD77986

SEQ ID NO: 106390 - RNA, 1413 nt, Artificial Sequence
  derived and/or modified sequence opt2 from neuraminidase__InfluenzaA__ABD77997
augaaccccaaccagaagaucaucaccaucggcuccaucuccaucgccaucggcauccucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacaacaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106391 - RNA, 1413 nt, Artificial Sequence; identical to SEQ ID NO: 106340
  derived and/or modified sequence opt2 from neuraminidase__InfluenzaA__ABD78008

SEQ ID NO: 106392 - RNA, 1413 nt, Artificial Sequence; identical to SEQ ID NO: 106340
  derived and/or modified sequence opt2 from neuraminidase__InfluenzaA__ABD78019

SEQ ID NO: 106393 - RNA, 1413 nt, Artificial Sequence
  derived and/or modified sequence opt2 from neuraminidase__InfluenzaA__ABD78030
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaaccgcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccaacaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106394 - RNA, 1413 nt, Artificial Sequence
  derived and/or modified sequence opt2 from neuraminidase__InfluenzaA__ABD78041
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccuccaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106395 - RNA, 1410 nt, Artificial Sequence; identical to SEQ ID NO: 106374
  derived and/or modified sequence opt2 from neuraminidase__InfluenzaA__ABD78052

SEQ ID NO: 106396 - RNA, 1413 nt, Artificial Sequence; identical to SEQ ID NO: 105908
  derived and/or modified sequence opt2 from neuraminidase__InfluenzaA__ABD78063

SEQ ID NO: 106397 - RNA, 1413 nt, Artificial Sequence; identical to SEQ ID NO: 105908
  derived and/or modified sequence opt2 from neuraminidase__InfluenzaA__ABD78074

SEQ ID NO: 106398 - RNA, 1413 nt, Artificial Sequence; identical to SEQ ID NO: 105908
  derived and/or modified sequence opt2 from neuraminidase__InfluenzaA__ABD78085

SEQ ID NO: 106399 - RNA, 1413 nt, Artificial Sequence; identical to SEQ ID NO: 105908
  derived and/or modified sequence opt2 from neuraminidase__InfluenzaA__ABD78096

SEQ ID NO: 106400 - RNA, 1410 nt, Artificial Sequence
  derived and/or modified sequence opt2 from neuraminidase__InfluenzaA__ABD78118
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106401 - RNA, 1410 nt, Artificial Sequence; identical to SEQ ID NO: 106400
  derived and/or modified sequence opt2 from neuraminidase__InfluenzaA__ABD78129

SEQ ID NO: 106402 - RNA, 1410 nt, Artificial Sequence; identical to SEQ ID NO: 105630
  derived and/or modified sequence opt2 from neuraminidase__InfluenzaA__ABD79035

SEQ ID NO: 106403 - RNA, 1353 nt, Artificial Sequence
  derived and/or modified sequence opt2 from neuraminidase__InfluenzaA__ABD79115
augaaccccaaccagaagaucaucaccaucggcuccaucugcauggucgucggcaucaucucccucaucuuccagaucggcaacaucgucuccaucuggaucucccacuccaucaccggcaccugcaaccgcuccaucuacgucaacaucuccaacaccaacgucgucgccggcaaggacaccaccuccgucauccucgccggcaacuccucccucugccccauccgcggcugggccaucuacuccaaggacaacggcguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccggcaccaucaaguccuggcgcaaggagauccuccgcacccaggaguccgagugcgucugcgucaacggcuccugcuucaccaucaugaccgacggccccuccggcggccccgccuccuacaagaucuucaagaucgagaagggcaaggucaccaaguccaucgagcucgacgcccccaacucccacuacgaggagugcuccugcuaccccgacaccuccaaggucaugugcgucugccgcgacaacuggcacggcuccaaccgccccugggucuccuucgaccagaaccucgacuaccagaugggcuacaucugcuccggcgucuucggcgacaacccccgccccaaggacggcaagggcuccugcggccccgucuacgucgacggcgccaacggcgucaagggcuucuccuaccgcuacggcaacggcgucuggaucggccgcaccaaguccuccuccucccgccagggcuucgagaugaucugggaccccaacggcuggaccgagaccgacuccaacuucuucaugaagcaggacgucgucgccgucaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 106404 - RNA, 1410 nt, Artificial Sequence
  derived and/or modified sequence opt2 from neuraminidase__InfluenzaA__ABD79126
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgacaagggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106405 - RNA, 1410 nt, Artificial Sequence; identical to SEQ ID NO: 106404
  derived and/or modified sequence opt2 from neuraminidase__InfluenzaA__ABD79137

SEQ ID NO: 106406 - RNA, 1410 nt, Artificial Sequence; identical to SEQ ID NO: 106404
  derived and/or modified sequence opt2 from neuraminidase__InfluenzaA__ABD79148

SEQ ID NO: 106407 - RNA, 1410 nt, Artificial Sequence; identical to SEQ ID NO: 106404
  derived and/or modified sequence opt2 from neuraminidase__InfluenzaA__ABD79159

SEQ ID NO: 106408 - RNA, 1410 nt, Artificial Sequence
  derived and/or modified sequence opt2 from neuraminidase__InfluenzaA__ABD79170
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacaacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucaaggagggcaagaucguccacgucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgacaagggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106409 - RNA, 1410 nt, Artificial Sequence; identical to SEQ ID NO: 106404
  derived and/or modified sequence opt2 from neuraminidase__InfluenzaA__ABD79181

SEQ ID NO: 106410 - RNA, 1410 nt, Artificial Sequence; identical to SEQ ID NO: 106404
  derived and/or modified sequence opt2 from neuraminidase__InfluenzaA__ABD79192

SEQ ID NO: 106411 - RNA, 1410 nt, Artificial Sequence
  derived and/or modified sequence opt2 from neuraminidase__InfluenzaA__ABD79203
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaagugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacaugaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgacaagggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106412 - RNA, 1410 nt, Artificial Sequence; identical to SEQ ID NO: 106404
  derived and/or modified sequence opt2 from neuraminidase__InfluenzaA__ABD79214

SEQ ID NO: 106413 - RNA, 1410 nt, Artificial Sequence
  derived and/or modified sequence opt2 from neuraminidase__InfluenzaA__ABD79236
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacaacaccgcccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucaaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgacaagggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106414 - RNA, 1410 nt, Artificial Sequence
  derived and/or modified sequence opt2 from neuraminidase__InfluenzaA__ABD79247
augaaccccaaccagaagaucaucaccaucggcuccgucucccucaccaucaccaccaucugcuuccucaugcagaucgccauccucgucaucaccgucacccuccacuucaagcagugcgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaugggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106415 - RNA, 1410 nt, Artificial Sequence; identical to SEQ ID NO: 105839
  derived and/or modified sequence opt2 from neuraminidase__InfluenzaA__ABD94737

SEQ ID NO: 106416 - RNA, 1410 nt, Artificial Sequence; identical to SEQ ID NO: 106224
  derived and/or modified sequence opt2 from neuraminidase__InfluenzaA__ABD94748

SEQ ID NO: 106417 - RNA, 1413 nt, Artificial Sequence; identical to SEQ ID NO: 106340
  derived and/or modified sequence opt2 from neuraminidase__InfluenzaA__ABD94759

SEQ ID NO: 106418 - RNA, 1410 nt, Artificial Sequence; identical to SEQ ID NO: 105573
  derived and/or modified sequence opt2 from neuraminidase__InfluenzaA__ABD94770

SEQ ID NO: 106419 - RNA, 1413 nt, Artificial Sequence; identical to SEQ ID NO: 105908
  derived and/or modified sequence opt2 from neuraminidase__InfluenzaA__ABD94792

SEQ ID NO: 106420 - RNA, 1413 nt, Artificial Sequence; identical to SEQ ID NO: 105908
  derived and/or modified sequence opt2 from neuraminidase__InfluenzaA__ABD94803

SEQ ID NO: 106421 - RNA, 1413 nt, Artificial Sequence; identical to SEQ ID NO: 105908
  derived and/or modified sequence opt2 from neuraminidase__InfluenzaA__ABD94814

SEQ ID NO: 106422 - RNA, 1410 nt, Artificial Sequence; identical to SEQ ID NO: 106085
  derived and/or modified sequence opt2 from neuraminidase__InfluenzaA__ABD94825

SEQ ID NO: 106423 - RNA, 1410 nt, Artificial Sequence
  derived and/or modified sequence opt2 from neuraminidase__InfluenzaA__ABD94847
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaagaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgucaccaagauccucuucaucgaggagggcaagaucguccacaucuccccccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106424 - RNA, 1410 nt, Artificial Sequence; identical to SEQ ID NO: 105638
  derived and/or modified sequence opt2 from neuraminidase__InfluenzaA__ABD94858

SEQ ID NO: 106425 - RNA, 1410 nt, Artificial Sequence; identical to SEQ ID NO: 105638
  derived and/or modified sequence opt2 from neuraminidase__InfluenzaA__ABD94880

SEQ ID NO: 106426 - RNA, 1410 nt, Artificial Sequence
  derived and/or modified sequence opt2 from neuraminidase__InfluenzaA__ABD94891
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagguccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106427 - RNA, 1410 nt, Artificial Sequence; identical to SEQ ID NO: 106404
  derived and/or modified sequence opt2 from neuraminidase__InfluenzaA__ABD94902

SEQ ID NO: 106428 - RNA, 1410 nt, Artificial Sequence
  derived and/or modified sequence opt2 from neuraminidase__InfluenzaA__ABD94924
augaaccccaaccagaagaucaucaccaucggcuccgucucccucaccaucgccaccaucugccuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106429 - RNA, 1410 nt, Artificial Sequence
  derived and/or modified sequence opt2 from neuraminidase__InfluenzaA__ABD94946
augaaccccaaccagaagaucaucaccaucggcuccgucucccucaccaucgccaccaucugcuuccucacccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 106430 - RNA, 1410 nt, Artificial Sequence
  derived and/or modified sequence opt2 from neuraminidase__InfluenzaA__ABD94957
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106431 - RNA, 1413 nt, Artificial Sequence; identical to SEQ ID NO: 106340
  derived and/or modified sequence opt2 from neuraminidase__InfluenzaA__ABD94968

SEQ ID NO: 106432 - RNA, 1413 nt, Artificial Sequence; identical to SEQ ID NO: 106340
  derived and/or modified sequence opt2 from neuraminidase__InfluenzaA__ABD94990

SEQ ID NO: 106433 - RNA, 1413 nt, Artificial Sequence
  derived and/or modified sequence opt2 from neuraminidase__InfluenzaA__ABD95001
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacauccacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccaugaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106434 - RNA, 1413 nt, Artificial Sequence
  derived and/or modified sequence opt2 from neuraminidase__InfluenzaA__ABD95012
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106435 - RNA, 1413 nt, Artificial Sequence; identical to SEQ ID NO: 106340
  derived and/or modified sequence opt2 from neuraminidase__InfluenzaA__ABD95023

SEQ ID NO: 106436 - RNA, 1413 nt, Artificial Sequence
  derived and/or modified sequence opt2 from neuraminidase__InfluenzaA__ABD95034
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucauccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106437 - RNA, 1413 nt, Artificial Sequence
  derived and/or modified sequence opt2 from neuraminidase__InfluenzaA__ABD95056
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaagaucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucaacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106438 - RNA, 1413 nt, Artificial Sequence; identical to SEQ ID NO: 105908
  derived and/or modified sequence opt2 from neuraminidase__InfluenzaA__ABD95067

SEQ ID NO: 106439 - RNA, 1413 nt, Artificial Sequence; identical to SEQ ID NO: 105908
  derived and/or modified sequence opt2 from neuraminidase__InfluenzaA__ABD95078

SEQ ID NO: 106440 - RNA, 1413 nt, Artificial Sequence; identical to SEQ ID NO: 106437
  derived and/or modified sequence opt2 from neuraminidase__InfluenzaA__ABD95089

SEQ ID NO: 106441 - RNA, 1413 nt, Artificial Sequence; identical to SEQ ID NO: 105908
  derived and/or modified sequence opt2 from neuraminidase__InfluenzaA__ABD95100

SEQ ID NO: 106442 - RNA, 1413 nt, Artificial Sequence
  derived and/or modified sequence opt2 from neuraminidase__InfluenzaA__ABD95111
augaaccccaaccagaagaucaucaccaucggcuccaucuccaucgccaucggcaugaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106443 - RNA, 1413 nt, Artificial Sequence; identical to SEQ ID NO: 106442
  derived and/or modified sequence opt2 from neuraminidase__InfluenzaA__ABD95122

SEQ ID NO: 106444 - RNA, 1413 nt, Artificial Sequence; identical to SEQ ID NO: 105908
  derived and/or modified sequence opt2 from neuraminidase__InfluenzaA__ABD95144

SEQ ID NO: 106445 - RNA, 1413 nt, Artificial Sequence; identical to SEQ ID NO: 105908
  derived and/or modified sequence opt2 from neuraminidase__InfluenzaA__ABD95155

SEQ ID NO: 106446 - RNA, 1413 nt, Artificial Sequence
  derived and/or modified sequence opt2 from neuraminidase__InfluenzaA__ABD95166
augaaccccaaccagaagaucaucaccaucggcuccaucuccaucgccaucggcaugaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106447 - RNA, 1413 nt, Artificial Sequence; identical to SEQ ID NO: 106437
  derived and/or modified sequence opt2 from neuraminidase__InfluenzaA__ABD95177

SEQ ID NO: 106448 - RNA, 1413 nt, Artificial Sequence
  derived and/or modified sequence opt2 from neuraminidase__InfluenzaA__ABD95188
augaaccccaaccagaagaucaucaccaucggcuccaucuccaccaccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106449 - RNA, 1413 nt, Artificial Sequence; identical to SEQ ID NO: 106437
  derived and/or modified sequence opt2 from neuraminidase__InfluenzaA__ABD95199

SEQ ID NO: 106450 - RNA, 1413 nt, Artificial Sequence; identical to SEQ ID NO: 105927
  derived and/or modified sequence opt2 from neuraminidase__InfluenzaA__ABD95210

SEQ ID NO: 106451 - RNA, 1413 nt, Artificial Sequence
  derived and/or modified sequence opt2 from neuraminidase__InfluenzaA__ABD95221
augaaccccaaccagaagaucaucaccaucggcuccaucuccaucgccaucggcaugaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106452 - RNA, 1413 nt, Artificial Sequence; identical to SEQ ID NO: 106442
  derived and/or modified sequence opt2 from neuraminidase__InfluenzaA__ABD95232

SEQ ID NO: 106453 - RNA, 1413 nt, Artificial Sequence; identical to SEQ ID NO: 105908
  derived and/or modified sequence opt2 from neuraminidase__InfluenzaA__ABD95243

SEQ ID NO: 106454 - RNA, 1413 nt, Artificial Sequence; identical to SEQ ID NO: 106442
  derived and/or modified sequence opt2 from neuraminidase__InfluenzaA__ABD95254

SEQ ID NO: 106455 - RNA, 1413 nt, Artificial Sequence; identical to SEQ ID NO: 105927
  derived and/or modified sequence opt2 from neuraminidase__InfluenzaA__ABD95265

SEQ ID NO: 106456 - RNA, 1413 nt, Artificial Sequence; identical to SEQ ID NO: 105908
  derived and/or modified sequence opt2 from neuraminidase__InfluenzaA__ABD95276

SEQ ID NO: 106457 - RNA, 1413 nt, Artificial Sequence
  derived and/or modified sequence opt2 from neuraminidase__InfluenzaA__ABD95287
augaaccccaaccagaagaucaucaccaucggcuccaucuccgucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106458 - RNA, 1413 nt, Artificial Sequence; identical to SEQ ID NO: 105908
  derived and/or modified sequence opt2 from neuraminidase__InfluenzaA__ABD95298

SEQ ID NO: 106459 - RNA, 1413 nt, Artificial Sequence
  derived and/or modified sequence opt2 from neuraminidase__InfluenzaA__ABD95309
augaaccccaaccagaagaucaucaccaucggcuccaucuccaucgccaucggcaugaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaagugcaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106460 - RNA, 1413 nt, Artificial Sequence; identical to SEQ ID NO: 105908
  derived and/or modified sequence opt2 from neuraminidase__InfluenzaA__ABD95320

SEQ ID NO: 106461 - RNA, 1413 nt, Artificial Sequence; identical to SEQ ID NO: 106437
  derived and/or modified sequence opt2 from neuraminidase__InfluenzaA__ABD95331

SEQ ID NO: 106462 - RNA, 1413 nt, Artificial Sequence
  derived and/or modified sequence opt2 from neuraminidase__InfluenzaA__ABD95342
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccguccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcaucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 106463 - RNA, 1413 nt, Artificial Sequence
  derived and/or modified sequence opt2 from neuraminidase__InfluenzaA__ABD95353
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 106464 - RNA, 1413 nt, Artificial Sequence; identical to SEQ ID NO: 106340
  derived and/or modified sequence opt2 from neuraminidase__InfluenzaA__ABE11660

SEQ ID NO: 106465 - RNA, 1413 nt, Artificial Sequence
  derived and/or modified sequence opt2 from neuraminidase__InfluenzaA__ABE11671
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaacaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106466 - RNA, 1413 nt, Artificial Sequence
  derived and/or modified sequence opt2 from neuraminidase__InfluenzaA__ABE11682
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106467 - RNA, 1413 nt, Artificial Sequence; identical to SEQ ID NO: 105908
  derived and/or modified sequence opt2 from neuraminidase__InfluenzaA__ABE11693

SEQ ID NO: 106468 - RNA, 1413 nt, Artificial Sequence; identical to SEQ ID NO: 105908
  derived and/or modified sequence opt2 from neuraminidase__InfluenzaA__ABE11704

SEQ ID NO: 106469 - RNA, 1413 nt, Artificial Sequence; identical to SEQ ID NO: 105908
  derived and/or modified sequence opt2 from neuraminidase__InfluenzaA__ABE11715

SEQ ID NO: 106470 - RNA, 1413 nt, Artificial Sequence; identical to SEQ ID NO: 106437
  derived and/or modified sequence opt2 from neuraminidase__InfluenzaA__ABE11726

SEQ ID NO: 106471 - RNA, 1413 nt, Artificial Sequence; identical to SEQ ID NO: 106442
  derived and/or modified sequence opt2 from neuraminidase__InfluenzaA__ABE11737

SEQ ID NO: 106472 - RNA, 1413 nt, Artificial Sequence; identical to SEQ ID NO: 105908
  derived and/or modified sequence opt2 from neuraminidase__InfluenzaA__ABE11815

SEQ ID NO: 106473 - RNA, 1413 nt, Artificial Sequence; identical to SEQ ID NO: 106437
  derived and/or modified sequence opt2 from neuraminidase__InfluenzaA__ABE11826

SEQ ID NO: 106474 - RNA, 1413 nt, Artificial Sequence; identical to SEQ ID NO: 106437
  derived and/or modified sequence opt2 from neuraminidase__InfluenzaA__ABE11837

SEQ ID NO: 106475 - RNA, 1413 nt, Artificial Sequence; identical to SEQ ID NO: 106437
  derived and/or modified sequence opt2 from neuraminidase__InfluenzaA__ABE11848

SEQ ID NO: 106476 - RNA, 1413 nt, Artificial Sequence; identical to SEQ ID NO: 106442
  derived and/or modified sequence opt2 from neuraminidase__InfluenzaA__ABE11859

SEQ ID NO: 106477 - RNA, 1413 nt, Artificial Sequence
  derived and/or modified sequence opt2 from neuraminidase__InfluenzaA__ABE11903
augaaccccaaccagaagaucaucaccaucggcuccaucuccauggccaucggcaucaucucccucauccuccagaucggcaacaucaucuccaucugggccucccacuccauccagaccggcucccagaacuacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 106478 - RNA, 1413 nt, Artificial Sequence
  derived and/or modified sequence opt2 from neuraminidase__InfluenzaA__ABE11925
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggcaaggucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgccgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106479 - RNA, 1413 nt, Artificial Sequence
  derived and/or modified sequence opt2 from neuraminidase__InfluenzaA__ABE11952
augaaccccaaccagaagaucaucaccaucggcuccaucuccauggccaucggcaucaucucccucauccuccagaucggcaacaucaucuccaucugggccucccacuccauccagaccggcucccagaacuacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccgacugguccuggcccgacggcgccgagcuccccuucaccaucgacaaguga

SEQ ID NO: 106480 - RNA, 1413 nt, Artificial Sequence
  derived and/or modified sequence opt2 from neuraminidase__InfluenzaA__ABE12035
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106481 - RNA, 1410 nt, Artificial Sequence; identical to SEQ ID NO: 106242
  derived and/or modified sequence opt2 from neuraminidase__InfluenzaA__ABE12094

SEQ ID NO: 106482 - RNA, 1410 nt, Artificial Sequence; identical to SEQ ID NO: 106374
  derived and/or modified sequence opt2 from neuraminidase__InfluenzaA__ABE12126

SEQ ID NO: 106483 - RNA, 1413 nt, Artificial Sequence; identical to SEQ ID NO: 105908
  derived and/or modified sequence opt2 from neuraminidase__InfluenzaA__ABE12263

SEQ ID NO: 106484 - RNA, 1410 nt, Artificial Sequence
  derived and/or modified sequence opt2 from neuraminidase__InfluenzaA__ABE12626
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaagugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagcgcggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106485 - RNA, 1410 nt, Artificial Sequence
  derived and/or modified sequence opt2 from neuraminidase__InfluenzaA__ABE12650
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucaaggagggcaagaucguccacaucuccccccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106486 - RNA, 1410 nt, Artificial Sequence
  derived and/or modified sequence opt2 from neuraminidase__InfluenzaA__ABE13095
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacggcuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgacaagggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106487 - RNA, 1410 nt, Artificial Sequence; identical to SEQ ID NO: 105638
  derived and/or modified sequence opt2 from neuraminidase__InfluenzaA__ABE13332

SEQ ID NO: 106488 - RNA, 1410 nt, Artificial Sequence; identical to SEQ ID NO: 105638
  derived and/or modified sequence opt2 from neuraminidase__InfluenzaA__ABE13558

SEQ ID NO: 106489 - RNA, 1410 nt, Artificial Sequence
  derived and/or modified sequence opt2 from neuraminidase__InfluenzaA__ABE13642
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106490 - RNA, 1410 nt, Artificial Sequence
  derived and/or modified sequence opt2 from neuraminidase__InfluenzaA__ABE13668
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106491 - RNA, 1410 nt, Artificial Sequence
  derived and/or modified sequence opt2 from neuraminidase__InfluenzaA__ABE13836
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106492 - RNA, 1410 nt, Artificial Sequence
  derived and/or modified sequence opt2 from neuraminidase__InfluenzaA__ABE14033
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106493 - RNA, 1410 nt, Artificial Sequence
  derived and/or modified sequence opt2 from neuraminidase__InfluenzaA__ABE14055
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucuccuccugguccaagaacauccuccgcacccaggaguccgagugcgucugcaucaacggcaccugcaccgucgucaugaccgacggcuccuccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106494 - RNA, 1410 nt, Artificial Sequence
  derived and/or modified sequence opt2 from neuraminidase__InfluenzaA__ABE14857
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaccaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106495 - RNA, 1410 nt, Artificial Sequence; identical to SEQ ID NO: 106492
  derived and/or modified sequence opt2 from neuraminidase__InfluenzaA__ABE15594

SEQ ID NO: 106496 - RNA, 1413 nt, Artificial Sequence
  derived and/or modified sequence opt2 from neuraminidase__InfluenzaA__ABE26994
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacuccuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106497 - RNA, 1350 nt, Artificial Sequence
  derived and/or modified sequence opt2 from neuraminidase__InfluenzaA__ABE97641
augaaccccaaccagaagaucaucaccaucggcuccaucugcauggucaucggcaucaucucccucaugcuccagaucggcaacaugaucuccaucugggucucccacuccauccagaccuggaaccagcaccaggccgaguccaucuccaacaccaacccccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccuggaucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaucggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaucgucuccugguccuggcccgacggcgccgagcuccccuucaccaucgacaaguga

SEQ ID NO: 106498 - RNA, 1350 nt, Artificial Sequence
  derived and/or modified sequence opt2 from neuraminidase__InfluenzaA__ABE97642
augaaccccaaccagaagaucaucaccaucggcuccaucugcauggucaucggcauggucucccucaugcuccagaucggcaacaugaucuccaucuggcucucccacuccauccagaccggcaaccagcaccaggccgaguccaucuccaacaacaaccuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaucaucgacaaguga

SEQ ID NO: 106499 - RNA, 1350 nt, Artificial Sequence
  derived and/or modified sequence opt2 from neuraminidase__InfluenzaA__ABE97644
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgcccucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106500 - RNA, 1350 nt, Artificial Sequence
  derived and/or modified sequence opt2 from neuraminidase__InfluenzaA__ABE97645
augaaccccaaccagaagaucaucaccaucggcuccaucugcauggucaucggcaccgucucccucaugcuccagaucggcaacaugaucuccaucugggucucccacuccauccagaccggcaaccagcaccaggccgagcccaccuccuccaccaacccccucaccgagaaggccgucgccuccgucacccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucgccuucaaguacggcaacggcgucuggaucggccgcaccaaguccaccaacucccgcuccggcuucgagaugaucugggaccccaacggcuggaccggccccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106501 - RNA, 1350 nt, Artificial Sequence
  derived and/or modified sequence opt2 from neuraminidase__InfluenzaA__ABE97646
augaaccccaaccagaagaucaucaccaucggcuccaucugcauggucaucggcaucgucucccucaugcuccagaucggcaacaugaucuccaucugggucucccacuccauccagaccgagaaccagcaccaggccgaguccaucuccaacaccaacccccccaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacacccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucuccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106502 - RNA, 1350 nt, Artificial Sequence
  derived and/or modified sequence opt2 from neuraminidase__InfluenzaA__ABE97647
augaaccccaaccagaagaucaucaccaucggcuccaucugcauggucaucggcaucgucucccucaugcuccagaucggcaacaugaucuccaucugggucucccacuccauccagaccggcaaccagcaccgcgccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106503 - RNA, 1350 nt, Artificial Sequence
  derived and/or modified sequence opt2 from neuraminidase__InfluenzaA__ABE97649
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106504 - RNA, 1350 nt, Artificial Sequence; identical to SEQ ID NO: 106503
  derived and/or modified sequence opt2 from neuraminidase__InfluenzaA__ABE97651

SEQ ID NO: 106505 - RNA, 1350 nt, Artificial Sequence; identical to SEQ ID NO: 106503
  derived and/or modified sequence opt2 from neuraminidase__InfluenzaA__ABE97653

SEQ ID NO: 106506 - RNA, 1350 nt, Artificial Sequence; identical to SEQ ID NO: 106503
  derived and/or modified sequence opt2 from neuraminidase__InfluenzaA__ABE97654

SEQ ID NO: 106507 - RNA, 1350 nt, Artificial Sequence
  derived and/or modified sequence opt2 from neuraminidase__InfluenzaA__ABE97655
augaaccccaaccagaagaucaucaccaucggcuccaucugcauggccaucggcaucgucucccucaugcuccagaucggcaacaugaucuccaucugggucucccacuccauccagaccggcaaccagcaccaggccgaguccaccuccaacaccaacccccucaccgagaaggccgucgccuccgucacccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucgccuucaaguacggcaacggcgucuggaucggccgcaccaaguccaccaacucccgcuccggcuucgagaugaucugggaccccaacggcuggaccggccccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106508 - RNA, 1350 nt, Artificial Sequence
  derived and/or modified sequence opt2 from neuraminidase__InfluenzaA__ABE97657
augaaccccaaccagaagaucaucaccaucggcuccaucugcauggucaucggcaccgucucccucguccuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcgacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccauguccuccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106509 - RNA, 1350 nt, Artificial Sequence
  derived and/or modified sequence opt2 from neuraminidase__InfluenzaA__ABE97658
augaaccccaaccagaagaucaucaccaucggcuccaucugcauggucaucggcaccaucucccucaugcuccagaucggcaacaugaucuccaucugggucucccacuccauccagaccggcaaccagcaccagaccgaguccaucuccaacaccaacccccucaccgagaaggccgucgccuccgucacccucgccggcaacuccucccucugcuccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcgacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccauguccuccaacggcgcccacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106510 - RNA, 1350 nt, Artificial Sequence
  derived and/or modified sequence opt2 from neuraminidase__InfluenzaA__ABE97659
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacgagaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcgacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccauguccuccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106511 - RNA, 1350 nt, Artificial Sequence
  derived and/or modified sequence opt2 from neuraminidase__InfluenzaA__ABE97660
augaaccccaaccagaagaucaucaccaucggcuccaucugcauggucaucggcaccaucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcgacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccauguccuccaacggcgcccacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106512 - RNA, 1350 nt, Artificial Sequence
  derived and/or modified sequence opt2 from neuraminidase__InfluenzaA__ABE97661
augaaccccaaccagaagaucaucaccaucggcuccaucugcauggucaucggcaccaucucccucaugcuccagaucggcaacaugaucuccaucugggucucccacuccauccagaccggcaaccagcaccagaccgaguccaucuccaacaccaacccccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcgacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccauguccuccaacggcgcccacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaccaccgacugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucaacuccgacaccgucuccugguccuggcccgacggcgccgagcuccccuucaccaucgacaaguga

SEQ ID NO: 106513 - RNA, 1350 nt, Artificial Sequence
  derived and/or modified sequence opt2 from neuraminidase__InfluenzaA__ABE97662
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaugcgcaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106514 - RNA, 1350 nt, Artificial Sequence
  derived and/or modified sequence opt2 from neuraminidase__InfluenzaA__ABE97663
augaaccccaaccagaagaucaucaccaucggcuccaucugcauggucaccggcaucgucucccucaugcuccagaucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuuccgcuacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106515 - RNA, 1350 nt, Artificial Sequence
  derived and/or modified sequence opt2 from neuraminidase__InfluenzaA__ABE97665
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccacggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106516 - RNA, 1350 nt, Artificial Sequence
  derived and/or modified sequence opt2 from neuraminidase__InfluenzaA__ABE97666
augaaccccaaccagaagaucaucaccaucggcuccaucugcauggucaccggcaucgucucccucaugcuccagaucggcaacaugaucuccaucugggucucccacuccauccacaccggcaaccagcaccaguccgagcccaucuccaacaccaacuuccucaccgagaaggccgucgccuccgucaagcucgccggcaacuccccccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacuccccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106517 - RNA, 1350 nt, Artificial Sequence
  derived and/or modified sequence opt2 from neuraminidase__InfluenzaA__ABE97667
augaaccccaaccagaagaucaucaccaucggcuccaucugcauggucaccggcaucgucucccucaugcuccagaucggcaacaugaucuccaucuggggcucccacuccauccacaccggcaaccagcaccaguccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcaagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaucgucggcugguccuggcccgacggcgccgagcuccccuucaccaucgacaaguga

SEQ ID NO: 106518 - RNA, 1350 nt, Artificial Sequence
  derived and/or modified sequence opt2 from neuraminidase__InfluenzaA__ABE97669
augaaccccaaccagaagaucaucaccaucggcuccaucugcauggucaccggcaucgucucccucaugcuccagaucggcaacaugaucuccaucugggucucccacuccauccacaccggcaaccagcaccaguccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106519 - RNA, 1350 nt, Artificial Sequence
  derived and/or modified sequence opt2 from neuraminidase__InfluenzaA__ABE97670
augaaccccaaccagaagaucaucaccaucggcuccaucugcauggucaccggcaucgucucccucaugcuccagaucggcaacaugaucuccaucugggucucccacuccauccacaccggcaaccagcaccaguccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacacccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106520 - RNA, 1350 nt, Artificial Sequence
  derived and/or modified sequence opt2 from neuraminidase__InfluenzaA__ABE97671
augaaccccaaccagaagaucaucaccaucggcuccaucugcauggucaccggcaucgucucccucaugcuccagaucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106521 - RNA, 1350 nt, Artificial Sequence
  derived and/or modified sequence opt2 from neuraminidase__InfluenzaA__ABE97672
augaaccccaaccagaagaucaucaccaucggcuccaucugcauggucaccggcaucgucucccucaugcuccagaucggcaacaugaucuccaucugggucucccacuccauccacaccggcaaccagcaccaggccgagcccaucuccaacaccaacuuccucaccgagaaggcccucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106522 - RNA, 1350 nt, Artificial Sequence
  derived and/or modified sequence opt2 from neuraminidase__InfluenzaA__ABE97675
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaucgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagaucgagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcugguccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106523 - RNA, 1350 nt, Artificial Sequence
  derived and/or modified sequence opt2 from neuraminidase__InfluenzaA__ABE97676
augaaccccaaccagaagaucaucaccaucggcuccaucugcauggucaccggcaucgucucccucaugcuccagaucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaacgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106524 - RNA, 1350 nt, Artificial Sequence
  derived and/or modified sequence opt2 from neuraminidase__InfluenzaA__ABE97677
augaaccccaaccagaagaucaucaccaucggcuccaucugcauggucaccggcaucgucucccucaugcuccagaucggcaacaucaucuccaucuggguccgccacuccauccacaccggcaaccagcaccaguccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106525 - RNA, 1350 nt, Artificial Sequence
  derived and/or modified sequence opt2 from neuraminidase__InfluenzaA__ABE97679
augaaccccaaccagaagaucaucaccaucggcuccaucugcauggucaccggcaucgucucccucaugcuccagaucggcaacaugaucuccaucuggguccgccacuccauccacaccggcaaccagcaccaguccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106526 - RNA, 1350 nt, Artificial Sequence; identical to SEQ ID NO: 106518
  derived and/or modified sequence opt2 from neuraminidase__InfluenzaA__ABE97680

SEQ ID NO: 106527 - RNA, 1350 nt, Artificial Sequence; identical to SEQ ID NO: 106518
  derived and/or modified sequence opt2 from neuraminidase__InfluenzaA__ABE97681

SEQ ID NO: 106528 - RNA, 1350 nt, Artificial Sequence; identical to SEQ ID NO: 106518
  derived and/or modified sequence opt2 from neuraminidase__InfluenzaA__ABE97682

SEQ ID NO: 106529 - RNA, 1350 nt, Artificial Sequence
  derived and/or modified sequence opt2 from neuraminidase__InfluenzaA__ABE97684
augaaccccaaccagaagaucaucaccaucggcuccaucugcauggucaccggcaucgucucccucaugcuccagaucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccggcaccgucggcugguccuggcccgacggcgccgagcuccccuucaccaucgacaaguga

SEQ ID NO: 106530 - RNA, 1350 nt, Artificial Sequence
  derived and/or modified sequence opt2 from neuraminidase__InfluenzaA__ABE97685
augaaccccaaccagaagaucaucaccaucggcuccaucugcauggucaccggcaucgucucccucaugcuccagaucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccggcggcugguccuggcccgacggcgccgagcuccccuucaccaucgacaaguga

SEQ ID NO: 106531 - RNA, 1350 nt, Artificial Sequence; identical to SEQ ID NO: 106520
  derived and/or modified sequence opt2 from neuraminidase__InfluenzaA__ABE97686

SEQ ID NO: 106532 - RNA, 1350 nt, Artificial Sequence
  derived and/or modified sequence opt2 from neuraminidase__InfluenzaA__ABE97687
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106533 - RNA, 1350 nt, Artificial Sequence
  derived and/or modified sequence opt2 from neuraminidase__InfluenzaA__ABE97688
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucugggucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaucaucgacaaguga

SEQ ID NO: 106534 - RNA, 1350 nt, Artificial Sequence
  derived and/or modified sequence opt2 from neuraminidase__InfluenzaA__ABE97690
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcucccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagaugaagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106535 - RNA, 1350 nt, Artificial Sequence
  derived and/or modified sequence opt2 from neuraminidase__InfluenzaA__ABE97691
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucaagcgcgagcccugcaucuccugcucccaccucaagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106536 - RNA, 1350 nt, Artificial Sequence
  derived and/or modified sequence opt2 from neuraminidase__InfluenzaA__ABE97694
augaaccccaaccagaagaucaugaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgacuccgucaagcucgccggcaacuccucccucugccccaucaacggcugggccgucuacuccaaggacaacuccauccgcaucggcuccaagggcgacgucuucgucauccgcgagcccuccgucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacgucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106537 - RNA, 1350 nt, Artificial Sequence
  derived and/or modified sequence opt2 from neuraminidase__InfluenzaA__ABE97696
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcuccgucaaggaccgcuccccccaccgcacccucauguccugcuccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106538 - RNA, 1350 nt, Artificial Sequence
  derived and/or modified sequence opt2 from neuraminidase__InfluenzaA__ABE97697
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaacgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacgagaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106539 - RNA, 1350 nt, Artificial Sequence
  derived and/or modified sequence opt2 from neuraminidase__InfluenzaA__ABE97702
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccuacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucuccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaccgacaaguga

SEQ ID NO: 106540 - RNA, 1350 nt, Artificial Sequence; identical to SEQ ID NO: 106532
  derived and/or modified sequence opt2 from neuraminidase__InfluenzaA__ABE97703

SEQ ID NO: 106541 - RNA, 1350 nt, Artificial Sequence; identical to SEQ ID NO: 106532
  derived and/or modified sequence opt2 from neuraminidase__InfluenzaA__ABE97705

SEQ ID NO: 106542 - RNA, 1350 nt, Artificial Sequence
  derived and/or modified sequence opt2 from neuraminidase__InfluenzaA__ABE97706
augaaccccaaccagaagaucaucaccaucggcuccaucugcauggucaccggcaucgucucccucaugcuccaggucggcaacaugaucucccucugggucucccacuccauccacaccggcaaccagcaccaggccgagcccaucuccaacaccaacuuccucaccgagcgcgccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccuccucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucugggccuccggcuccuccaucuccuucugcggcgucaacuccgacaccgucggcugguccuggcccgacggcgccgagcuccccuucaccaucgacaaguga

SEQ ID NO: 106543 - RNA, 1350 nt, Artificial Sequence
  derived and/or modified sequence opt2 from neuraminidase__InfluenzaA__ABE97707
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaagggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106544 - RNA, 1350 nt, Artificial Sequence
  derived and/or modified sequence opt2 from neuraminidase__InfluenzaA__ABE97708
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccacggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagaugaagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106545 - RNA, 1350 nt, Artificial Sequence
  derived and/or modified sequence opt2 from neuraminidase__InfluenzaA__ABE97710
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucucccucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106546 - RNA, 1350 nt, Artificial Sequence
  derived and/or modified sequence opt2 from neuraminidase__InfluenzaA__ABE97711
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagauggucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106547 - RNA, 1350 nt, Artificial Sequence; identical to SEQ ID NO: 106532
  derived and/or modified sequence opt2 from neuraminidase__InfluenzaA__ABE97712

SEQ ID NO: 106548 - RNA, 1350 nt, Artificial Sequence; identical to SEQ ID NO: 106532
  derived and/or modified sequence opt2 from neuraminidase__InfluenzaA__ABE97713

SEQ ID NO: 106549 - RNA, 1350 nt, Artificial Sequence; identical to SEQ ID NO: 106532
  derived and/or modified sequence opt2 from neuraminidase__InfluenzaA__ABE97715

SEQ ID NO: 106550 - RNA, 1350 nt, Artificial Sequence
  derived and/or modified sequence opt2 from neuraminidase__InfluenzaA__ABE97717
augaaccccaaccagaagaucaucaccaucggcuccaucugcauggucaccggcaucgucaaccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccguccccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106551 - RNA, 1350 nt, Artificial Sequence
  derived and/or modified sequence opt2 from neuraminidase__InfluenzaA__ABE97718
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucgacuccgacaccgucggcugguccuggcccgacggcgccgagcuccccuucaccaucgacaaguga

SEQ ID NO: 106552 - RNA, 1350 nt, Artificial Sequence
  derived and/or modified sequence opt2 from neuraminidase__InfluenzaA__ABE97719
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagaugaagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106553 - RNA, 1350 nt, Artificial Sequence
  derived and/or modified sequence opt2 from neuraminidase__InfluenzaA__ABE97720
augaaccccaaccagaagaucaucaccaucggcuccaucugcauggucaccggcaucgucucccucaugcuccaggucggcaacaugaucuccaucugggucucccacuccauccacaccggcaaccagcaccaggccgagcccaucuccaacgccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaccccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106554 - RNA, 1410 nt, Artificial Sequence; identical to SEQ ID NO: 106325
  derived and/or modified sequence opt2 from neuraminidase__InfluenzaA__ABF47553

SEQ ID NO: 106555 - RNA, 1413 nt, Artificial Sequence; identical to SEQ ID NO: 105908
  derived and/or modified sequence opt2 from neuraminidase__InfluenzaA__ABF47564

SEQ ID NO: 106556 - RNA, 1413 nt, Artificial Sequence
  derived and/or modified sequence opt2 from neuraminidase__InfluenzaA__ABF47575
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucgcccucgccggcaacuccucccucugcuccaucuccggcugggccaucuacaccaaggacaacuccauccgcaucggcuccaagggcgacgucuucgucauccgcgagcccuucaucuccugcucccacuucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106557 - RNA, 1413 nt, Artificial Sequence; identical to SEQ ID NO: 105908
  derived and/or modified sequence opt2 from neuraminidase__InfluenzaA__ABF47586

SEQ ID NO: 106558 - RNA, 1410 nt, Artificial Sequence; identical to SEQ ID NO: 105638
  derived and/or modified sequence opt2 from neuraminidase__InfluenzaA__ABF47597

SEQ ID NO: 106559 - RNA, 1413 nt, Artificial Sequence; identical to SEQ ID NO: 106480
  derived and/or modified sequence opt2 from neuraminidase__InfluenzaA__ABF47608

SEQ ID NO: 106560 - RNA, 1410 nt, Artificial Sequence
  derived and/or modified sequence opt2 from neuraminidase__InfluenzaA__ABF47619
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccgccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106561 - RNA, 1413 nt, Artificial Sequence
  derived and/or modified sequence opt2 from neuraminidase__InfluenzaA__ABF47630
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccauggcccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106562 - RNA, 1413 nt, Artificial Sequence
  derived and/or modified sequence opt2 from neuraminidase__InfluenzaA__ABF47652
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccaacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106563 - RNA, 1413 nt, Artificial Sequence; identical to SEQ ID NO: 106480
  derived and/or modified sequence opt2 from neuraminidase__InfluenzaA__ABF47663

SEQ ID NO: 106564 - RNA, 1413 nt, Artificial Sequence
  derived and/or modified sequence opt2 from neuraminidase__InfluenzaA__ABF47674
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcauccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106565 - RNA, 1413 nt, Artificial Sequence; identical to SEQ ID NO: 106463
  derived and/or modified sequence opt2 from neuraminidase__InfluenzaA__ABF47696

SEQ ID NO: 106566 - RNA, 1413 nt, Artificial Sequence
  derived and/or modified sequence opt2 from neuraminidase__InfluenzaA__ABF47707
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaagggcaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 106567 - RNA, 1413 nt, Artificial Sequence; identical to SEQ ID NO: 106463
  derived and/or modified sequence opt2 from neuraminidase__InfluenzaA__ABF47718

SEQ ID NO: 106568 - RNA, 1413 nt, Artificial Sequence; identical to SEQ ID NO: 106463
  derived and/or modified sequence opt2 from neuraminidase__InfluenzaA__ABF47729

SEQ ID NO: 106569 - RNA, 1413 nt, Artificial Sequence; identical to SEQ ID NO: 106463
  derived and/or modified sequence opt2 from neuraminidase__InfluenzaA__ABF47740

SEQ ID NO: 106570 - RNA, 1413 nt, Artificial Sequence
  derived and/or modified sequence opt2 from neuraminidase__InfluenzaA__ABF47751
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgccaacugguccuggcccgacggcgccgagcuccccuucaccaucgacaaguga

SEQ ID NO: 106571 - RNA, 1413 nt, Artificial Sequence
  derived and/or modified sequence opt2 from neuraminidase__InfluenzaA__ABF47773
augaaccccaaccagaagaucaucaccaucggcuccaucugcaugaccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgccaacugguccuggcccgacggcgccgagcuccccuucaccaucgacaaguga

SEQ ID NO: 106572 - RNA, 1413 nt, Artificial Sequence; identical to SEQ ID NO: 106571
  derived and/or modified sequence opt2 from neuraminidase__InfluenzaA__ABF47784

SEQ ID NO: 106573 - RNA, 1413 nt, Artificial Sequence; identical to SEQ ID NO: 106571
  derived and/or modified sequence opt2 from neuraminidase__InfluenzaA__ABF47795

SEQ ID NO: 106574 - RNA, 1413 nt, Artificial Sequence; identical to SEQ ID NO: 106571
  derived and/or modified sequence opt2 from neuraminidase__InfluenzaA__ABF47806

SEQ ID NO: 106575 - RNA, 1413 nt, Artificial Sequence; identical to SEQ ID NO: 106571
  derived and/or modified sequence opt2 from neuraminidase__InfluenzaA__ABF47817

SEQ ID NO: 106576 - RNA, 1413 nt, Artificial Sequence; identical to SEQ ID NO: 106571
  derived and/or modified sequence opt2 from neuraminidase__InfluenzaA__ABF47839

SEQ ID NO: 106577 - RNA, 1413 nt, Artificial Sequence; identical to SEQ ID NO: 106571
  derived and/or modified sequence opt2 from neuraminidase__InfluenzaA__ABF47850

SEQ ID NO: 106578 - RNA, 1413 nt, Artificial Sequence; identical to SEQ ID NO: 106340
  derived and/or modified sequence opt2 from neuraminidase__InfluenzaA__ABF47872

SEQ ID NO: 106579 - RNA, 1413 nt, Artificial Sequence; identical to SEQ ID NO: 106340
  derived and/or modified sequence opt2 from neuraminidase__InfluenzaA__ABF47883

SEQ ID NO: 106580 - RNA, 1413 nt, Artificial Sequence; identical to SEQ ID NO: 106340
  derived and/or modified sequence opt2 from neuraminidase__InfluenzaA__ABF47894

SEQ ID NO: 106581 - RNA, 1410 nt, Artificial Sequence; identical to SEQ ID NO: 106356
  derived and/or modified sequence opt2 from neuraminidase__InfluenzaA__ABF47905

SEQ ID NO: 106582 - RNA, 1362 nt, Artificial Sequence
  derived and/or modified sequence opt2 from neuraminidase__InfluenzaA__ABF47958
augaaccccaaccagaagaucaucaccaucggcuccaucugcauggucgucggcaucaucucccucauccuccagaucggcaacaucaucuccaucuggaucucccacuccauccagaccggcaaccagaaccacaccggcaucugcaaccagggcuccaucaccuacaaggucgucgccggccaggacuccaccuccgucauccucaccggcaacuccucccucugccccauccgcggcugggccauccacuccaaggacaacggcauccgcaucggcuccaagggcgacgucuucgucauccgcgagcccuucaucuccugcucccaccucgagugccgcaccuucuuccucacccagggcgcccuccucaacgacaagcacucccgcggcaccuucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagaacauccuccgcacccaggaguccgagugcaccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuacaagaucggcuacaucugcuccggcgucuucggcgacaacccccgccccaaggacggcaccggcuccugcggccccgucuccgccgacggcgccaacggcgucaagggcuucuccuacaaguacggcaacggcgucuggaucggccgcaccaaguccgacuccucccgccacggcuucgagaugaucugggaccccaacggcuggaccgagaccgacucccgcuucuccaugcgccaggacgucgucgccaugaccgaccgcuccggcuacuccggcuccuucguccagcaccccgagcucaccggccucgacugcaugcgccccugcuucugggucgagcucauccgcggccuccccgaggaggacgccaucuggaccuccggcuccaucaucuccuucugcggcgucaacuccgacaccgucgacugguccuggcccgacggcgccgagcuccccuucaccaucgacaaguga

SEQ ID NO: 106583 - RNA, 1350 nt, Artificial Sequence
  derived and/or modified sequence opt2 from neuraminidase__InfluenzaA__ABF56651
augaaccccaaccagaagaucaucaccaucggcuccaucugcauggucaccggcaucgucucccucaugcuccaggucggcaacaugaucuccaucugggucucccacuccauccacaccggcucccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 106584 - RNA, 1410 nt, Artificial Sequence; identical to SEQ ID NO: 106339
  derived and/or modified sequence opt2 from neuraminidase__InfluenzaA__ABF82654

SEQ ID NO: 106585 - RNA, 1413 nt, Artificial Sequence; identical to SEQ ID NO: 105908
  derived and/or modified sequence opt2 from neuraminidase__InfluenzaA__ABF82665

SEQ ID NO: 106586 - RNA, 1413 nt, Artificial Sequence; identical to SEQ ID NO: 105908
  derived and/or modified sequence opt2 from neuraminidase__InfluenzaA__ABF82676

SEQ ID NO: 106587 - RNA, 1413 nt, Artificial Sequence
  derived and/or modified sequence opt2 from neuraminidase__InfluenzaA__ABF82687
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaagaccaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucaacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106588 - RNA, 1410 nt, Artificial Sequence
  derived and/or modified sequence opt2 from neuraminidase__InfluenzaA__ABF82698
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgacaagggcaaccgcuccggcuacuccggcaucuucuccgucgagggcaaguccugcaccaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106589 - RNA, 1410 nt, Artificial Sequence; identical to SEQ ID NO: 105638
  derived and/or modified sequence opt2 from neuraminidase__InfluenzaA__ABF82709

SEQ ID NO: 106590 - RNA, 1413 nt, Artificial Sequence; identical to SEQ ID NO: 105927
  derived and/or modified sequence opt2 from neuraminidase__InfluenzaA__ABF82822

SEQ ID NO: 106591 - RNA, 1413 nt, Artificial Sequence; identical to SEQ ID NO: 105908
  derived and/or modified sequence opt2 from neuraminidase__InfluenzaA__ABF82833

SEQ ID NO: 106592 - RNA, 1413 nt, Artificial Sequence; identical to SEQ ID NO: 105908
  derived and/or modified sequence opt2 from neuraminidase__InfluenzaA__ABF82844

SEQ ID NO: 106593 - RNA, 1413 nt, Artificial Sequence
  derived and/or modified sequence opt2 from neuraminidase__InfluenzaA__ABF82855
augaaccccaaccagaagaucaucaccaucggcuccaucuccaucgccaucggcaucaucucccucaugcuccagaucggcaacaucaucuccaucugggccucccacuccauccagaucggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106594 - RNA, 1413 nt, Artificial Sequence; identical to SEQ ID NO: 105908
  derived and/or modified sequence opt2 from neuraminidase__InfluenzaA__ABF82866

SEQ ID NO: 106595 - RNA, 1413 nt, Artificial Sequence; identical to SEQ ID NO: 106442
  derived and/or modified sequence opt2 from neuraminidase__InfluenzaA__ABF82888

SEQ ID NO: 106596 - RNA, 1413 nt, Artificial Sequence; identical to SEQ ID NO: 105908
  derived and/or modified sequence opt2 from neuraminidase__InfluenzaA__ABF82910

SEQ ID NO: 106597 - RNA, 1413 nt, Artificial Sequence; identical to SEQ ID NO: 105908
  derived and/or modified sequence opt2 from neuraminidase__InfluenzaA__ABF82921

SEQ ID NO: 106598 - RNA, 1413 nt, Artificial Sequence; identical to SEQ ID NO: 105908
  derived and/or modified sequence opt2 from neuraminidase__InfluenzaA__ABF82932

SEQ ID NO: 106599 - RNA, 1413 nt, Artificial Sequence; identical to SEQ ID NO: 105908
  derived and/or modified sequence opt2 from neuraminidase__InfluenzaA__ABF82943

SEQ ID NO: 106600 - RNA, 1350 nt, Artificial Sequence
  derived and/or modified sequence opt2 from neuraminidase__InfluenzaA__ABG20474
augaaccccaaccagaagaucaucaccaucggcuccaucugcauggucaucggcaucgucucccucaugcuccagaucggcaacaugaucuccaucugggucucccacuccauccagaccggcaaccagcgccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacguccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuucuucugcggcgucaacuccgacaccgucuccugguccuggcccgacggcgccgagcuccccuucaccaucgacaaguga

SEQ ID NO: 106601 - RNA, 1410 nt, Artificial Sequence; identical to SEQ ID NO: 105638
  derived and/or modified sequence opt2 from neuraminidase__InfluenzaA__ABG26761

SEQ ID NO: 106602 - RNA, 1410 nt, Artificial Sequence
  derived and/or modified sequence opt2 from neuraminidase__InfluenzaA__ABG26772
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucaaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106603 - RNA, 1413 nt, Artificial Sequence
  derived and/or modified sequence opt2 from neuraminidase__InfluenzaA__ABG26783
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccaacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106604 - RNA, 1413 nt, Artificial Sequence; identical to SEQ ID NO: 106480
  derived and/or modified sequence opt2 from neuraminidase__InfluenzaA__ABG26794

SEQ ID NO: 106605 - RNA, 1410 nt, Artificial Sequence
  derived and/or modified sequence opt2 from neuraminidase__InfluenzaA__ABG26805
augaaccccaaccagaagaucaucaccaucggcuccgucucccucaccaucgccaccaucugcuuccucacccagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccagaucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106606 - RNA, 1413 nt, Artificial Sequence; identical to SEQ ID NO: 106463
  derived and/or modified sequence opt2 from neuraminidase__InfluenzaA__ABG26816

SEQ ID NO: 106607 - RNA, 1413 nt, Artificial Sequence; identical to SEQ ID NO: 106571
  derived and/or modified sequence opt2 from neuraminidase__InfluenzaA__ABG26827

SEQ ID NO: 106608 - RNA, 1413 nt, Artificial Sequence; identical to SEQ ID NO: 106571
  derived and/or modified sequence opt2 from neuraminidase__InfluenzaA__ABG26838

SEQ ID NO: 106609 - RNA, 1410 nt, Artificial Sequence
  derived and/or modified sequence opt2 from neuraminidase__InfluenzaA__ABG26860
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucaucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106610 - RNA, 1410 nt, Artificial Sequence
  derived and/or modified sequence opt2 from neuraminidase__InfluenzaA__ABG26871
augaaccccaaccagaagaucaucaccaucggcuccgucucccucaccaucgccaccaucugcuuccucaugcagaucgccauccucgucaccaccgucacccuccacuucaagcaguacgagugcaacuccccccccuacaaccagaucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106611 - RNA, 1410 nt, Artificial Sequence
  derived and/or modified sequence opt2 from neuraminidase__InfluenzaA__ABG26893
augaaccccaaccagaagaucaucaccaucggcuccaucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106612 - RNA, 1410 nt, Artificial Sequence
  derived and/or modified sequence opt2 from neuraminidase__InfluenzaA__ABG26915
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucuccuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106613 - RNA, 1410 nt, Artificial Sequence
  derived and/or modified sequence opt2 from neuraminidase__InfluenzaA__ABG26937
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106614 - RNA, 1413 nt, Artificial Sequence; identical to SEQ ID NO: 105908
  derived and/or modified sequence opt2 from neuraminidase__InfluenzaA__ABG26948

SEQ ID NO: 106615 - RNA, 1410 nt, Artificial Sequence; identical to SEQ ID NO: 105678
  derived and/or modified sequence opt2 from neuraminidase__InfluenzaA__ABG26959

SEQ ID NO: 106616 - RNA, 1413 nt, Artificial Sequence
  derived and/or modified sequence opt2 from neuraminidase__InfluenzaA__ABG37123
augaaccccaaccagaagaucaucaccaucggcuccaucuccaucaccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106617 - RNA, 1410 nt, Artificial Sequence
  derived and/or modified sequence opt2 from neuraminidase__InfluenzaA__ABG37134
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106618 - RNA, 1410 nt, Artificial Sequence; identical to SEQ ID NO: 105638
  derived and/or modified sequence opt2 from neuraminidase__InfluenzaA__ABG37145

SEQ ID NO: 106619 - RNA, 1410 nt, Artificial Sequence
  derived and/or modified sequence opt2 from neuraminidase__InfluenzaA__ABG37156
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccaacuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106620 - RNA, 1410 nt, Artificial Sequence
  derived and/or modified sequence opt2 from neuraminidase__InfluenzaA__ABG37167
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucuccuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106621 - RNA, 1410 nt, Artificial Sequence
  derived and/or modified sequence opt2 from neuraminidase__InfluenzaA__ABG37189
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccagguccuccucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106622 - RNA, 1410 nt, Artificial Sequence
  derived and/or modified sequence opt2 from neuraminidase__InfluenzaA__ABG37200
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgacuccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106623 - RNA, 1410 nt, Artificial Sequence
  derived and/or modified sequence opt2 from neuraminidase__InfluenzaA__ABG37211
augaaccccaaccagaagaucaucaccaucggcuccgucucccucaccaucgccaccaucugcuuccucacccagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 106624 - RNA, 1410 nt, Artificial Sequence
  derived and/or modified sequence opt2 from neuraminidase__InfluenzaA__ABG37233
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggccaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccaccaucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccaacuccuacugccgcaaccccaacaacgagaagggcucccacggcgucaagggcugggccuucgacgacggcaacgacgucuggaugggccgcaccaucuccgccgagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106625 - RNA, 1410 nt, Artificial Sequence
  derived and/or modified sequence opt2 from neuraminidase__InfluenzaA__ABG37244
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106626 - RNA, 1410 nt, Artificial Sequence; identical to SEQ ID NO: 106625
  derived and/or modified sequence opt2 from neuraminidase__InfluenzaA__ABG37255

SEQ ID NO: 106627 - RNA, 1410 nt, Artificial Sequence; identical to SEQ ID NO: 106612
  derived and/or modified sequence opt2 from neuraminidase__InfluenzaA__ABG37266

SEQ ID NO: 106628 - RNA, 1410 nt, Artificial Sequence; identical to SEQ ID NO: 106625
  derived and/or modified sequence opt2 from neuraminidase__InfluenzaA__ABG37277

SEQ ID NO: 106629 - RNA, 1410 nt, Artificial Sequence; identical to SEQ ID NO: 106625
  derived and/or modified sequence opt2 from neuraminidase__InfluenzaA__ABG37288

SEQ ID NO: 106630 - RNA, 1410 nt, Artificial Sequence; identical to SEQ ID NO: 106625
  derived and/or modified sequence opt2 from neuraminidase__InfluenzaA__ABG37310

SEQ ID NO: 106631 - RNA, 1410 nt, Artificial Sequence; identical to SEQ ID NO: 106612
  derived and/or modified sequence opt2 from neuraminidase__InfluenzaA__ABG37321

SEQ ID NO: 106632 - RNA, 1410 nt, Artificial Sequence
  derived and/or modified sequence opt2 from neuraminidase__InfluenzaA__ABG37332
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucguccaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcggcgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106633 - RNA, 1410 nt, Artificial Sequence
  derived and/or modified sequence opt2 from neuraminidase__InfluenzaA__ABG37343
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaagaacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106634 - RNA, 1410 nt, Artificial Sequence; identical to SEQ ID NO: 106613
  derived and/or modified sequence opt2 from neuraminidase__InfluenzaA__ABG37354

SEQ ID NO: 106635 - RNA, 1413 nt, Artificial Sequence; identical to SEQ ID NO: 106340
  derived and/or modified sequence opt2 from neuraminidase__InfluenzaA__ABG37365

SEQ ID NO: 106636 - RNA, 1413 nt, Artificial Sequence; identical to SEQ ID NO: 106442
  derived and/or modified sequence opt2 from neuraminidase__InfluenzaA__ABG37387

SEQ ID NO: 106637 - RNA, 1413 nt, Artificial Sequence
  derived and/or modified sequence opt2 from neuraminidase__InfluenzaA__ABG37398
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacaacaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 106638 - RNA, 1410 nt, Artificial Sequence
  derived and/or modified sequence opt2 from neuraminidase__InfluenzaA__ABG37409
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcccugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgaccgcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106639 - RNA, 1410 nt, Artificial Sequence
  derived and/or modified sequence opt2 from neuraminidase__InfluenzaA__ABG37442
augaaccccaaccagaagaucaucaccaucggcuccgucucccucaccaucgccaccaucugcuuccucaugcagaucgccauccucgucaccaccgucacccuccacuucaagcaguucgagugcaacuccccccccaacaaccaggucaugcucugcgagcccaccaucaucgagggcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106640 - RNA, 1410 nt, Artificial Sequence; identical to SEQ ID NO: 105666
  derived and/or modified sequence opt2 from neuraminidase__InfluenzaA__ABG37453

SEQ ID NO: 106641 - RNA, 1410 nt, Artificial Sequence; identical to SEQ ID NO: 105678
  derived and/or modified sequence opt2 from neuraminidase__InfluenzaA__ABG37464

SEQ ID NO: 106642 - RNA, 1410 nt, Artificial Sequence
  derived and/or modified sequence opt2 from neuraminidase__InfluenzaA__ABG37475
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106643 - RNA, 1410 nt, Artificial Sequence
  derived and/or modified sequence opt2 from neuraminidase__InfluenzaA__ABG37486
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaaccucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106644 - RNA, 1410 nt, Artificial Sequence
  derived and/or modified sequence opt2 from neuraminidase__InfluenzaA__ABG37497
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagaucaucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106645 - RNA, 1410 nt, Artificial Sequence; identical to SEQ ID NO: 105692
  derived and/or modified sequence opt2 from neuraminidase__InfluenzaA__ABG37508

SEQ ID NO: 106646 - RNA, 1410 nt, Artificial Sequence; identical to SEQ ID NO: 106103
  derived and/or modified sequence opt2 from neuraminidase__InfluenzaA__ABG37519

SEQ ID NO: 106647 - RNA, 1410 nt, Artificial Sequence; identical to SEQ ID NO: 106103
  derived and/or modified sequence opt2 from neuraminidase__InfluenzaA__ABG37530

SEQ ID NO: 106648 - RNA, 1410 nt, Artificial Sequence; identical to SEQ ID NO: 106103
  derived and/or modified sequence opt2 from neuraminidase__InfluenzaA__ABG37541

SEQ ID NO: 106649 - RNA, 1410 nt, Artificial Sequence; identical to SEQ ID NO: 106103
  derived and/or modified sequence opt2 from neuraminidase__InfluenzaA__ABG37552

SEQ ID NO: 106650 - RNA, 1410 nt, Artificial Sequence; identical to SEQ ID NO: 106103
  derived and/or modified sequence opt2 from neuraminidase__InfluenzaA__ABG37563

SEQ ID NO: 106651 - RNA, 1410 nt, Artificial Sequence; identical to SEQ ID NO: 106103
  derived and/or modified sequence opt2 from neuraminidase__InfluenzaA__ABG37585

SEQ ID NO: 106652 - RNA, 1410 nt, Artificial Sequence; identical to SEQ ID NO: 106103
  derived and/or modified sequence opt2 from neuraminidase__InfluenzaA__ABG37596

SEQ ID NO: 106653 - RNA, 1410 nt, Artificial Sequence; identical to SEQ ID NO: 106103
  derived and/or modified sequence opt2 from neuraminidase__InfluenzaA__ABG37607

SEQ ID NO: 106654 - RNA, 1410 nt, Artificial Sequence; identical to SEQ ID NO: 106103
  derived and/or modified sequence opt2 from neuraminidase__InfluenzaA__ABG37618

SEQ ID NO: 106655 - RNA, 1413 nt, Artificial Sequence; identical to SEQ ID NO: 106340
  derived and/or modified sequence opt2 from neuraminidase__InfluenzaA__ABG47810

SEQ ID NO: 106656 - RNA, 1413 nt, Artificial Sequence
  derived and/or modified sequence opt2 from neuraminidase__InfluenzaA__ABG47832
augaaccccaaccagaagaucaucaccaucggcuccaucuccaucgccaucggcaucaucucccucauccuccaggucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccaacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106657 - RNA, 1413 nt, Artificial Sequence; identical to SEQ ID NO: 106480
  derived and/or modified sequence opt2 from neuraminidase__InfluenzaA__ABG47843

SEQ ID NO: 106658 - RNA, 1410 nt, Artificial Sequence
  derived and/or modified sequence opt2 from neuraminidase__InfluenzaA__ABG47865
augaaccccaaccagaagaucaucaccaucggcuccgucucccucaccaucgccaccaucugcuuccucaugcagaucgccauccucgucaucaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106659 - RNA, 1410 nt, Artificial Sequence; identical to SEQ ID NO: 106625
  derived and/or modified sequence opt2 from neuraminidase__InfluenzaA__ABG47876

SEQ ID NO: 106660 - RNA, 1410 nt, Artificial Sequence; identical to SEQ ID NO: 106625
  derived and/or modified sequence opt2 from neuraminidase__InfluenzaA__ABG47887

SEQ ID NO: 106661 - RNA, 1410 nt, Artificial Sequence; identical to SEQ ID NO: 106612
  derived and/or modified sequence opt2 from neuraminidase__InfluenzaA__ABG47898

SEQ ID NO: 106662 - RNA, 1410 nt, Artificial Sequence; identical to SEQ ID NO: 106625
  derived and/or modified sequence opt2 from neuraminidase__InfluenzaA__ABG47909

SEQ ID NO: 106663 - RNA, 1410 nt, Artificial Sequence; identical to SEQ ID NO: 106613
  derived and/or modified sequence opt2 from neuraminidase__InfluenzaA__ABG47920

SEQ ID NO: 106664 - RNA, 1410 nt, Artificial Sequence; identical to SEQ ID NO: 106613
  derived and/or modified sequence opt2 from neuraminidase__InfluenzaA__ABG47931

SEQ ID NO: 106665 - RNA, 1410 nt, Artificial Sequence; identical to SEQ ID NO: 106613
  derived and/or modified sequence opt2 from neuraminidase__InfluenzaA__ABG47942

SEQ ID NO: 106666 - RNA, 1410 nt, Artificial Sequence
  derived and/or modified sequence opt2 from neuraminidase__InfluenzaA__ABG47953
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccaacaucaaccucaugcccaucuga

SEQ ID NO: 106667 - RNA, 1410 nt, Artificial Sequence
  derived and/or modified sequence opt2 from neuraminidase__InfluenzaA__ABG47964
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccagaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106668 - RNA, 1410 nt, Artificial Sequence
  derived and/or modified sequence opt2 from neuraminidase__InfluenzaA__ABG47975
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcgaccccaacaacgagcgcggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106669 - RNA, 1410 nt, Artificial Sequence
  derived and/or modified sequence opt2 from neuraminidase__InfluenzaA__ABG47986
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaagcccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106670 - RNA, 1410 nt, Artificial Sequence; identical to SEQ ID NO: 106613
  derived and/or modified sequence opt2 from neuraminidase__InfluenzaA__ABG47997

SEQ ID NO: 106671 - RNA, 1410 nt, Artificial Sequence
  derived and/or modified sequence opt2 from neuraminidase__InfluenzaA__ABG48008
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgccgcaacgacuccuccuccuccuccuacugccgcaagcccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106672 - RNA, 1410 nt, Artificial Sequence
  derived and/or modified sequence opt2 from neuraminidase__InfluenzaA__ABG48019
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgccugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106673 - RNA, 1410 nt, Artificial Sequence; identical to SEQ ID NO: 106613
  derived and/or modified sequence opt2 from neuraminidase__InfluenzaA__ABG48030

SEQ ID NO: 106674 - RNA, 1410 nt, Artificial Sequence; identical to SEQ ID NO: 106613
  derived and/or modified sequence opt2 from neuraminidase__InfluenzaA__ABG48041

SEQ ID NO: 106675 - RNA, 1413 nt, Artificial Sequence; identical to SEQ ID NO: 106340
  derived and/or modified sequence opt2 from neuraminidase__InfluenzaA__ABG48052

SEQ ID NO: 106676 - RNA, 1410 nt, Artificial Sequence; identical to SEQ ID NO: 106242
  derived and/or modified sequence opt2 from neuraminidase__InfluenzaA__ABG48063

SEQ ID NO: 106677 - RNA, 1410 nt, Artificial Sequence; identical to SEQ ID NO: 106365
  derived and/or modified sequence opt2 from neuraminidase__InfluenzaA__ABG48074

SEQ ID NO: 106678 - RNA, 1410 nt, Artificial Sequence; identical to SEQ ID NO: 105666
  derived and/or modified sequence opt2 from neuraminidase__InfluenzaA__ABG48085

SEQ ID NO: 106679 - RNA, 1410 nt, Artificial Sequence
  derived and/or modified sequence opt2 from neuraminidase__InfluenzaA__ABG48107
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagacccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106680 - RNA, 1410 nt, Artificial Sequence; identical to SEQ ID NO: 105678
  derived and/or modified sequence opt2 from neuraminidase__InfluenzaA__ABG48118

SEQ ID NO: 106681 - RNA, 1410 nt, Artificial Sequence; identical to SEQ ID NO: 105678
  derived and/or modified sequence opt2 from neuraminidase__InfluenzaA__ABG48129

SEQ ID NO: 106682 - RNA, 1410 nt, Artificial Sequence; identical to SEQ ID NO: 105666
  derived and/or modified sequence opt2 from neuraminidase__InfluenzaA__ABG48140

SEQ ID NO: 106683 - RNA, 1410 nt, Artificial Sequence; identical to SEQ ID NO: 105678
  derived and/or modified sequence opt2 from neuraminidase__InfluenzaA__ABG48151

SEQ ID NO: 106684 - RNA, 1410 nt, Artificial Sequence; identical to SEQ ID NO: 105666
  derived and/or modified sequence opt2 from neuraminidase__InfluenzaA__ABG48173

SEQ ID NO: 106685 - RNA, 1410 nt, Artificial Sequence; identical to SEQ ID NO: 105678
  derived and/or modified sequence opt2 from neuraminidase__InfluenzaA__ABG48184

SEQ ID NO: 106686 - RNA, 1410 nt, Artificial Sequence
  derived and/or modified sequence opt2 from neuraminidase__InfluenzaA__ABG48195
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugcaucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106687 - RNA, 1410 nt, Artificial Sequence
  derived and/or modified sequence opt2 from neuraminidase__InfluenzaA__ABG48206
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucaacgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106688 - RNA, 1410 nt, Artificial Sequence; identical to SEQ ID NO: 106103
  derived and/or modified sequence opt2 from neuraminidase__InfluenzaA__ABG48217

SEQ ID NO: 106689 - RNA, 1410 nt, Artificial Sequence; identical to SEQ ID NO: 106103
  derived and/or modified sequence opt2 from neuraminidase__InfluenzaA__ABG48228

SEQ ID NO: 106690 - RNA, 1410 nt, Artificial Sequence; identical to SEQ ID NO: 106687
  derived and/or modified sequence opt2 from neuraminidase__InfluenzaA__ABG48239

SEQ ID NO: 106691 - RNA, 1410 nt, Artificial Sequence; identical to SEQ ID NO: 106103
  derived and/or modified sequence opt2 from neuraminidase__InfluenzaA__ABG48250

SEQ ID NO: 106692 - RNA, 1410 nt, Artificial Sequence
  derived and/or modified sequence opt2 from neuraminidase__InfluenzaA__ABG48272
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106693 - RNA, 1410 nt, Artificial Sequence
  derived and/or modified sequence opt2 from neuraminidase__InfluenzaA__ABG48294
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucauccccugccagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccuggucccgcaacauccuccgcacccaggaguccgagugcgucugcaucaacggcaccugcaccgucgucaugaccgacggcuccgccuccgagcgcgccgacaccaagauccucuucaucgaggagggcaaggucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucaucuccuccuacgucugcuccggccucgucggcgacaccccccgccgcaacgacuccuccuccuccuccuacugccagaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucgaccucaugcccaucuga

SEQ ID NO: 106694 - RNA, 1410 nt, Artificial Sequence
  derived and/or modified sequence opt2 from neuraminidase__InfluenzaA__ABG48305
augaaccccaaccagaagaucaucaucaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106695 - RNA, 1410 nt, Artificial Sequence
  derived and/or modified sequence opt2 from neuraminidase__InfluenzaA__ABG48316
augaaccccaaccagaagaucaucaccaucggcuccgucucccucaccgucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106696 - RNA, 1410 nt, Artificial Sequence
  derived and/or modified sequence opt2 from neuraminidase__InfluenzaA__ABG48327
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccgcggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106697 - RNA, 1410 nt, Artificial Sequence
  derived and/or modified sequence opt2 from neuraminidase__InfluenzaA__ABG48338
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106698 - RNA, 1410 nt, Artificial Sequence; identical to SEQ ID NO: 106697
  derived and/or modified sequence opt2 from neuraminidase__InfluenzaA__ABG48349

SEQ ID NO: 106699 - RNA, 1410 nt, Artificial Sequence
  derived and/or modified sequence opt2 from neuraminidase__InfluenzaA__ABG48360
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucauguccgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggcaagcucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106700 - RNA, 1410 nt, Artificial Sequence; identical to SEQ ID NO: 106697
  derived and/or modified sequence opt2 from neuraminidase__InfluenzaA__ABG48371

SEQ ID NO: 106701 - RNA, 1410 nt, Artificial Sequence
  derived and/or modified sequence opt2 from neuraminidase__InfluenzaA__ABG67138
augaaccccaaccagaagaucaucaccaucggcuccgucucccucaccaucgccaccaucugcuuccucacccagaucgccauccucgucaccaccgucacccuccacuucaagcaguacgagugcaacuccccccccuccaaccaggucaugcucugcgagcccaccaccaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106702 - RNA, 1410 nt, Artificial Sequence; identical to SEQ ID NO: 105638
  derived and/or modified sequence opt2 from neuraminidase__InfluenzaA__ABG67149

SEQ ID NO: 106703 - RNA, 1410 nt, Artificial Sequence
  derived and/or modified sequence opt2 from neuraminidase__InfluenzaA__ABG67160
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcuccugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcgucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106704 - RNA, 1410 nt, Artificial Sequence
  derived and/or modified sequence opt2 from neuraminidase__InfluenzaA__ABG67171
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106705 - RNA, 1410 nt, Artificial Sequence; identical to SEQ ID NO: 106625
  derived and/or modified sequence opt2 from neuraminidase__InfluenzaA__ABG67182

SEQ ID NO: 106706 - RNA, 1410 nt, Artificial Sequence
  derived and/or modified sequence opt2 from neuraminidase__InfluenzaA__ABG67193
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaccaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaagaacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106707 - RNA, 1410 nt, Artificial Sequence; identical to SEQ ID NO: 106625
  derived and/or modified sequence opt2 from neuraminidase__InfluenzaA__ABG67204

SEQ ID NO: 106708 - RNA, 1410 nt, Artificial Sequence
  derived and/or modified sequence opt2 from neuraminidase__InfluenzaA__ABG67215
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcggccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106709 - RNA, 1410 nt, Artificial Sequence; identical to SEQ ID NO: 106613
  derived and/or modified sequence opt2 from neuraminidase__InfluenzaA__ABG67226

SEQ ID NO: 106710 - RNA, 1410 nt, Artificial Sequence; identical to SEQ ID NO: 106613
  derived and/or modified sequence opt2 from neuraminidase__InfluenzaA__ABG67248

SEQ ID NO: 106711 - RNA, 1413 nt, Artificial Sequence; identical to SEQ ID NO: 106340
  derived and/or modified sequence opt2 from neuraminidase__InfluenzaA__ABG67480

SEQ ID NO: 106712 - RNA, 1413 nt, Artificial Sequence; identical to SEQ ID NO: 105908
  derived and/or modified sequence opt2 from neuraminidase__InfluenzaA__ABG67494

SEQ ID NO: 106713 - RNA, 1410 nt, Artificial Sequence; identical to SEQ ID NO: 105666
  derived and/or modified sequence opt2 from neuraminidase__InfluenzaA__ABG67505

SEQ ID NO: 106714 - RNA, 1410 nt, Artificial Sequence; identical to SEQ ID NO: 105666
  derived and/or modified sequence opt2 from neuraminidase__InfluenzaA__ABG67516

SEQ ID NO: 106715 - RNA, 1410 nt, Artificial Sequence; identical to SEQ ID NO: 106679
  derived and/or modified sequence opt2 from neuraminidase__InfluenzaA__ABG67527

SEQ ID NO: 106716 - RNA, 1410 nt, Artificial Sequence
  derived and/or modified sequence opt2 from neuraminidase__InfluenzaA__ABG67538
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaccaucgagcgcaacaccaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucaucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106717 - RNA, 1410 nt, Artificial Sequence
  derived and/or modified sequence opt2 from neuraminidase__InfluenzaA__ABG67549
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaacgaggucugguggaccuccaacuccaucgucgucuucugcggcaccuccggcaccuacggcaccggcuccuggcccgacggcgccgacaucaaccucaugcccaucuga

SEQ ID NO: 106718 - RNA, 1410 nt, Artificial Sequence; identical to SEQ ID NO: 106103
  derived and/or modified sequence opt2 from neuraminidase__InfluenzaA__ABG67560

SEQ ID NO: 106719 - RNA, 1410 nt, Artificial Sequence; identical to SEQ ID NO: 106103
  derived and/or modified sequence opt2 from neuraminidase__InfluenzaA__ABG67571

SEQ ID NO: 106720 - RNA, 1410 nt, Artificial Sequence
  derived and/or modified sequence opt2 from neuraminidase__InfluenzaA__ABG67582
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgccaagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106721 - RNA, 1410 nt, Artificial Sequence; identical to SEQ ID NO: 106687
  derived and/or modified sequence opt2 from neuraminidase__InfluenzaA__ABG67593

SEQ ID NO: 106722 - RNA, 1410 nt, Artificial Sequence; identical to SEQ ID NO: 106103
  derived and/or modified sequence opt2 from neuraminidase__InfluenzaA__ABG67604

SEQ ID NO: 106723 - RNA, 1410 nt, Artificial Sequence; identical to SEQ ID NO: 106103
  derived and/or modified sequence opt2 from neuraminidase__InfluenzaA__ABG67615

SEQ ID NO: 106724 - RNA, 1410 nt, Artificial Sequence; identical to SEQ ID NO: 106103
  derived and/or modified sequence opt2 from neuraminidase__InfluenzaA__ABG67626

SEQ ID NO: 106725 - RNA, 1410 nt, Artificial Sequence; identical to SEQ ID NO: 106103
  derived and/or modified sequence opt2 from neuraminidase__InfluenzaA__ABG67637

SEQ ID NO: 106726 - RNA, 1410 nt, Artificial Sequence; identical to SEQ ID NO: 106103
  derived and/or modified sequence opt2 from neuraminidase__InfluenzaA__ABG67648

SEQ ID NO: 106727 - RNA, 1410 nt, Artificial Sequence
  derived and/or modified sequence opt2 from neuraminidase__InfluenzaA__ABG67659
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucucccgcgacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106728 - RNA, 1410 nt, Artificial Sequence
  derived and/or modified sequence opt2 from neuraminidase__InfluenzaA__ABG67670
augaaccccaaccagaagaucaucaccaucggcuccgucucccucaccaucgccaccaucugcuuccucaugcagaucgccauccucaucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106729 - RNA, 1410 nt, Artificial Sequence; identical to SEQ ID NO: 106242
  derived and/or modified sequence opt2 from neuraminidase__InfluenzaA__ABG79944

SEQ ID NO: 106730 - RNA, 1413 nt, Artificial Sequence; identical to SEQ ID NO: 106571
  derived and/or modified sequence opt2 from neuraminidase__InfluenzaA__ABG79955

SEQ ID NO: 106731 - RNA, 1410 nt, Artificial Sequence
  derived and/or modified sequence opt2 from neuraminidase__InfluenzaA__ABG79966
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccagaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106732 - RNA, 1410 nt, Artificial Sequence
  derived and/or modified sequence opt2 from neuraminidase__InfluenzaA__ABG79977
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggccaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106733 - RNA, 1410 nt, Artificial Sequence; identical to SEQ ID NO: 106625
  derived and/or modified sequence opt2 from neuraminidase__InfluenzaA__ABG79988

SEQ ID NO: 106734 - RNA, 1410 nt, Artificial Sequence; identical to SEQ ID NO: 106625
  derived and/or modified sequence opt2 from neuraminidase__InfluenzaA__ABG79999

SEQ ID NO: 106735 - RNA, 1410 nt, Artificial Sequence
  derived and/or modified sequence opt2 from neuraminidase__InfluenzaA__ABG80010
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggcaagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106736 - RNA, 1410 nt, Artificial Sequence; identical to SEQ ID NO: 106625
  derived and/or modified sequence opt2 from neuraminidase__InfluenzaA__ABG80021

SEQ ID NO: 106737 - RNA, 1410 nt, Artificial Sequence
  derived and/or modified sequence opt2 from neuraminidase__InfluenzaA__ABG80032
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccaucaucuacgacggccgccucgucgacuccaucuccuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106738 - RNA, 1410 nt, Artificial Sequence; identical to SEQ ID NO: 106612
  derived and/or modified sequence opt2 from neuraminidase__InfluenzaA__ABG80043

SEQ ID NO: 106739 - RNA, 1410 nt, Artificial Sequence; identical to SEQ ID NO: 106625
  derived and/or modified sequence opt2 from neuraminidase__InfluenzaA__ABG80054

SEQ ID NO: 106740 - RNA, 1410 nt, Artificial Sequence; identical to SEQ ID NO: 106612
  derived and/or modified sequence opt2 from neuraminidase__InfluenzaA__ABG80065

SEQ ID NO: 106741 - RNA, 1410 nt, Artificial Sequence
  derived and/or modified sequence opt2 from neuraminidase__InfluenzaA__ABG80076
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaagaacugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106742 - RNA, 1410 nt, Artificial Sequence
  derived and/or modified sequence opt2 from neuraminidase__InfluenzaA__ABG80087
augaaccccaaccagaagaucaucaccaucggcuccgucucccucaccaucgccaccaucugcuuccucaugcagaucgccguccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106743 - RNA, 1410 nt, Artificial Sequence; identical to SEQ ID NO: 106669
  derived and/or modified sequence opt2 from neuraminidase__InfluenzaA__ABG80098

SEQ ID NO: 106744 - RNA, 1410 nt, Artificial Sequence; identical to SEQ ID NO: 106613
  derived and/or modified sequence opt2 from neuraminidase__InfluenzaA__ABG80109

SEQ ID NO: 106745 - RNA, 1410 nt, Artificial Sequence
  derived and/or modified sequence opt2 from neuraminidase__InfluenzaA__ABG80120
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcaucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106746 - RNA, 1410 nt, Artificial Sequence
  derived and/or modified sequence opt2 from neuraminidase__InfluenzaA__ABG80131
augaaccccaaccagaagaucaucaccaucggcuccgucucccucaccaucgccaccaucugcuuccucaugcagaucgccaucauggucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106747 - RNA, 1410 nt, Artificial Sequence; identical to SEQ ID NO: 106613
  derived and/or modified sequence opt2 from neuraminidase__InfluenzaA__ABG80142

SEQ ID NO: 106748 - RNA, 1410 nt, Artificial Sequence; identical to SEQ ID NO: 106669
  derived and/or modified sequence opt2 from neuraminidase__InfluenzaA__ABG80153

SEQ ID NO: 106749 - RNA, 1410 nt, Artificial Sequence; identical to SEQ ID NO: 106613
  derived and/or modified sequence opt2 from neuraminidase__InfluenzaA__ABG80164

SEQ ID NO: 106750 - RNA, 1413 nt, Artificial Sequence; identical to SEQ ID NO: 106340
  derived and/or modified sequence opt2 from neuraminidase__InfluenzaA__ABG80186

SEQ ID NO: 106751 - RNA, 1410 nt, Artificial Sequence; identical to SEQ ID NO: 105573
  derived and/or modified sequence opt2 from neuraminidase__InfluenzaA__ABG80197

SEQ ID NO: 106752 - RNA, 1410 nt, Artificial Sequence; identical to SEQ ID NO: 105765
  derived and/or modified sequence opt2 from neuraminidase__InfluenzaA__ABG80219

SEQ ID NO: 106753 - RNA, 1410 nt, Artificial Sequence
  derived and/or modified sequence opt2 from neuraminidase__InfluenzaA__ABG80230
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccgaguccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106754 - RNA, 1410 nt, Artificial Sequence; identical to SEQ ID NO: 106103
  derived and/or modified sequence opt2 from neuraminidase__InfluenzaA__ABG80241

SEQ ID NO: 106755 - RNA, 1410 nt, Artificial Sequence; identical to SEQ ID NO: 106103
  derived and/or modified sequence opt2 from neuraminidase__InfluenzaA__ABG80252

SEQ ID NO: 106756 - RNA, 1410 nt, Artificial Sequence; identical to SEQ ID NO: 106687
  derived and/or modified sequence opt2 from neuraminidase__InfluenzaA__ABG80263

SEQ ID NO: 106757 - RNA, 1410 nt, Artificial Sequence; identical to SEQ ID NO: 106248
  derived and/or modified sequence opt2 from neuraminidase__InfluenzaA__ABG80274

SEQ ID NO: 106758 - RNA, 1410 nt, Artificial Sequence; identical to SEQ ID NO: 105839
  derived and/or modified sequence opt2 from neuraminidase__InfluenzaA__ABG80285

SEQ ID NO: 106759 - RNA, 1410 nt, Artificial Sequence; identical to SEQ ID NO: 105839
  derived and/or modified sequence opt2 from neuraminidase__InfluenzaA__ABG80296

SEQ ID NO: 106760 - RNA, 1410 nt, Artificial Sequence; identical to SEQ ID NO: 105839
  derived and/or modified sequence opt2 from neuraminidase__InfluenzaA__ABG80307

SEQ ID NO: 106761 - RNA, 1410 nt, Artificial Sequence; identical to SEQ ID NO: 106226
  derived and/or modified sequence opt2 from neuraminidase__InfluenzaA__ABG80318

SEQ ID NO: 106762 - RNA, 1410 nt, Artificial Sequence; identical to SEQ ID NO: 105839
  derived and/or modified sequence opt2 from neuraminidase__InfluenzaA__ABG80329

SEQ ID NO: 106763 - RNA, 1410 nt, Artificial Sequence; identical to SEQ ID NO: 105839
  derived and/or modified sequence opt2 from neuraminidase__InfluenzaA__ABG80340

SEQ ID NO: 106764 - RNA, 1410 nt, Artificial Sequence; identical to SEQ ID NO: 106697
  derived and/or modified sequence opt2 from neuraminidase__InfluenzaA__ABG80351

SEQ ID NO: 106765 - RNA, 1410 nt, Artificial Sequence
  derived and/or modified sequence opt2 from neuraminidase__InfluenzaA__ABG80373
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106766 - RNA, 1410 nt, Artificial Sequence; identical to SEQ ID NO: 106765
  derived and/or modified sequence opt2 from neuraminidase__InfluenzaA__ABG80384

SEQ ID NO: 106767 - RNA, 1410 nt, Artificial Sequence
  derived and/or modified sequence opt2 from neuraminidase__InfluenzaA__ABG80395
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccaagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaacauguccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106768 - RNA, 1410 nt, Artificial Sequence; identical to SEQ ID NO: 106697
  derived and/or modified sequence opt2 from neuraminidase__InfluenzaA__ABG80406

SEQ ID NO: 106769 - RNA, 1410 nt, Artificial Sequence; identical to SEQ ID NO: 106697
  derived and/or modified sequence opt2 from neuraminidase__InfluenzaA__ABG80417

SEQ ID NO: 106770 - RNA, 1410 nt, Artificial Sequence; identical to SEQ ID NO: 106697
  derived and/or modified sequence opt2 from neuraminidase__InfluenzaA__ABG80428

SEQ ID NO: 106771 - RNA, 1410 nt, Artificial Sequence; identical to SEQ ID NO: 105638
  derived and/or modified sequence opt2 from neuraminidase__InfluenzaA__ABG88292

SEQ ID NO: 106772 - RNA, 1413 nt, Artificial Sequence; identical to SEQ ID NO: 106562
  derived and/or modified sequence opt2 from neuraminidase__InfluenzaA__ABG88314

SEQ ID NO: 106773 - RNA, 1413 nt, Artificial Sequence
  derived and/or modified sequence opt2 from neuraminidase__InfluenzaA__ABG88325
augaaccccaaccagaagaucaucaccaucggcuccaccuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccuccgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaccggcuacaucugcuccggcgucuucggcgacaacccccgccccaaggacggcgagggcuccugcaaccccgucaccgccgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106774 - RNA, 1413 nt, Artificial Sequence
  derived and/or modified sequence opt2 from neuraminidase__InfluenzaA__ABG88336
augaaccccaaccagaagaucaucaccaucggcuccaucugcauggccaucggcaucaucucccucauccuccagaucggcaacaucaucuccaucugggucucccacuccauccagaccggcaaccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccguccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuacaagaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagcucggcuacaucugcuccggcaucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaccaccaccaucuggaccuccggcuccuccaucuccuucugcggcgucaacuccgacaccgucaacugguccuggcccgacggcgccgagcuccccuucaccaucgacaaguga

SEQ ID NO: 106775 - RNA, 1413 nt, Artificial Sequence
  derived and/or modified sequence opt2 from neuraminidase__InfluenzaA__ABG88347
augaaccccaaccagaagaucaucaccaucggcuccaucugcauggccaucggcaucaucggccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccguccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuacaagaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagcucggcuacaucugcuccggcaucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaccaccaccaucuggaccuccggcuccuccaucuccuucugcggcgucaacuccgacaccgucaacugguccuggcccgacggcgccgagcuccccuucaccaucgacaaguga

SEQ ID NO: 106776 - RNA, 1410 nt, Artificial Sequence
  derived and/or modified sequence opt2 from neuraminidase__InfluenzaA__ABG88358
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacauccgcccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106777 - RNA, 1410 nt, Artificial Sequence; identical to SEQ ID NO: 106625
  derived and/or modified sequence opt2 from neuraminidase__InfluenzaA__ABG88369

SEQ ID NO: 106778 - RNA, 1410 nt, Artificial Sequence; identical to SEQ ID NO: 106625
  derived and/or modified sequence opt2 from neuraminidase__InfluenzaA__ABG88380

SEQ ID NO: 106779 - RNA, 1410 nt, Artificial Sequence; identical to SEQ ID NO: 106625
  derived and/or modified sequence opt2 from neuraminidase__InfluenzaA__ABG88391

SEQ ID NO: 106780 - RNA, 1410 nt, Artificial Sequence; identical to SEQ ID NO: 106612
  derived and/or modified sequence opt2 from neuraminidase__InfluenzaA__ABG88402

SEQ ID NO: 106781 - RNA, 1410 nt, Artificial Sequence; identical to SEQ ID NO: 106669
  derived and/or modified sequence opt2 from neuraminidase__InfluenzaA__ABG88413

SEQ ID NO: 106782 - RNA, 1410 nt, Artificial Sequence; identical to SEQ ID NO: 106613
  derived and/or modified sequence opt2 from neuraminidase__InfluenzaA__ABG88424

SEQ ID NO: 106783 - RNA, 1410 nt, Artificial Sequence; identical to SEQ ID NO: 106613
  derived and/or modified sequence opt2 from neuraminidase__InfluenzaA__ABG88435

SEQ ID NO: 106784 - RNA, 1410 nt, Artificial Sequence; identical to SEQ ID NO: 106613
  derived and/or modified sequence opt2 from neuraminidase__InfluenzaA__ABG88446

SEQ ID NO: 106785 - RNA, 1410 nt, Artificial Sequence
  derived and/or modified sequence opt2 from neuraminidase__InfluenzaA__ABG88457
augaaccccaaccagaagaucaucaccaucggcuccgucucccucaccaccgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucaaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccagaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106786 - RNA, 1410 nt, Artificial Sequence; identical to SEQ ID NO: 106613
  derived and/or modified sequence opt2 from neuraminidase__InfluenzaA__ABG88468

SEQ ID NO: 106787 - RNA, 1410 nt, Artificial Sequence; identical to SEQ ID NO: 106613
  derived and/or modified sequence opt2 from neuraminidase__InfluenzaA__ABG88479

SEQ ID NO: 106788 - RNA, 1410 nt, Artificial Sequence; identical to SEQ ID NO: 106613
  derived and/or modified sequence opt2 from neuraminidase__InfluenzaA__ABG88490

SEQ ID NO: 106789 - RNA, 1410 nt, Artificial Sequence; identical to SEQ ID NO: 106613
  derived and/or modified sequence opt2 from neuraminidase__InfluenzaA__ABG88501

SEQ ID NO: 106790 - RNA, 1410 nt, Artificial Sequence; identical to SEQ ID NO: 106613
  derived and/or modified sequence opt2 from neuraminidase__InfluenzaA__ABG88512

SEQ ID NO: 106791 - RNA, 1410 nt, Artificial Sequence; identical to SEQ ID NO: 106613
  derived and/or modified sequence opt2 from neuraminidase__InfluenzaA__ABG88523

SEQ ID NO: 106792 - RNA, 1410 nt, Artificial Sequence
  derived and/or modified sequence opt2 from neuraminidase__InfluenzaA__ABG88534
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagaacaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106793 - RNA, 1410 nt, Artificial Sequence; identical to SEQ ID NO: 106305
  derived and/or modified sequence opt2 from neuraminidase__InfluenzaA__ABG88567

SEQ ID NO: 106794 - RNA, 1410 nt, Artificial Sequence
  derived and/or modified sequence opt2 from neuraminidase__InfluenzaA__ABG88600
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106795 - RNA, 1410 nt, Artificial Sequence; identical to SEQ ID NO: 105666
  derived and/or modified sequence opt2 from neuraminidase__InfluenzaA__ABG88611

SEQ ID NO: 106796 - RNA, 1410 nt, Artificial Sequence; identical to SEQ ID NO: 105678
  derived and/or modified sequence opt2 from neuraminidase__InfluenzaA__ABG88622

SEQ ID NO: 106797 - RNA, 1410 nt, Artificial Sequence; identical to SEQ ID NO: 105666
  derived and/or modified sequence opt2 from neuraminidase__InfluenzaA__ABG88633

SEQ ID NO: 106798 - RNA, 1410 nt, Artificial Sequence; identical to SEQ ID NO: 106717
  derived and/or modified sequence opt2 from neuraminidase__InfluenzaA__ABG88655

SEQ ID NO: 106799 - RNA, 1410 nt, Artificial Sequence; identical to SEQ ID NO: 106717
  derived and/or modified sequence opt2 from neuraminidase__InfluenzaA__ABG88666

SEQ ID NO: 106800 - RNA, 1410 nt, Artificial Sequence; identical to SEQ ID NO: 106103
  derived and/or modified sequence opt2 from neuraminidase__InfluenzaA__ABG88677

SEQ ID NO: 106801 - RNA, 1410 nt, Artificial Sequence; identical to SEQ ID NO: 106717
  derived and/or modified sequence opt2 from neuraminidase__InfluenzaA__ABG88688

SEQ ID NO: 106802 - RNA, 1410 nt, Artificial Sequence; identical to SEQ ID NO: 106103
  derived and/or modified sequence opt2 from neuraminidase__InfluenzaA__ABG88699

SEQ ID NO: 106803 - RNA, 1410 nt, Artificial Sequence; identical to SEQ ID NO: 105839
  derived and/or modified sequence opt2 from neuraminidase__InfluenzaA__ABG88710

SEQ ID NO: 106804 - RNA, 1410 nt, Artificial Sequence; identical to SEQ ID NO: 105839
  derived and/or modified sequence opt2 from neuraminidase__InfluenzaA__ABG88721

SEQ ID NO: 106805 - RNA, 1410 nt, Artificial Sequence
  derived and/or modified sequence opt2 from neuraminidase__InfluenzaA__ABG88732
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106806 - RNA, 1410 nt, Artificial Sequence; identical to SEQ ID NO: 106765
  derived and/or modified sequence opt2 from neuraminidase__InfluenzaA__ABG88743

SEQ ID NO: 106807 - RNA, 1410 nt, Artificial Sequence; identical to SEQ ID NO: 106765
  derived and/or modified sequence opt2 from neuraminidase__InfluenzaA__ABG88754

SEQ ID NO: 106808 - RNA, 1410 nt, Artificial Sequence; identical to SEQ ID NO: 106031
  derived and/or modified sequence opt2 from neuraminidase__InfluenzaA__ABG88765

SEQ ID NO: 106809 - RNA, 1410 nt, Artificial Sequence; identical to SEQ ID NO: 106697
  derived and/or modified sequence opt2 from neuraminidase__InfluenzaA__ABG88776

SEQ ID NO: 106810 - RNA, 1410 nt, Artificial Sequence; identical to SEQ ID NO: 106697
  derived and/or modified sequence opt2 from neuraminidase__InfluenzaA__ABG88787

SEQ ID NO: 106811 - RNA, 1410 nt, Artificial Sequence
  derived and/or modified sequence opt2 from neuraminidase__InfluenzaA__ABG88820
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaagugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106812 - RNA, 1350 nt, Artificial Sequence
  derived and/or modified sequence opt2 from neuraminidase__InfluenzaA__ABI16506
augaaccccaaccagaagaucaucaccaucggcuccaucugcauggucaucggcaucgucucccucaugcuccagaucggcaacauggucucccucugggucucccacuccauccagaccggcaaccagcaccaggucgagcccaucuccaacaccaacuuccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaugaucaccgacaccaucaaguccuggcgcaacaacauccuccgcacccaggaguccgagugcgucugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaagucccccuccucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106813 - RNA, 1413 nt, Artificial Sequence; identical to SEQ ID NO: 106477
  derived and/or modified sequence opt2 from neuraminidase__InfluenzaA__ABI20840

SEQ ID NO: 106814 - RNA, 1413 nt, Artificial Sequence
  derived and/or modified sequence opt2 from neuraminidase__InfluenzaA__ABI20862
augaaccccaaccagaagaucaucaccaucggcuccaucugcaugaccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaccggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgccaacugguccuggcccgacggcgccgagcuccccuucaccaucgacaaguga

SEQ ID NO: 106815 - RNA, 1413 nt, Artificial Sequence
  derived and/or modified sequence opt2 from neuraminidase__InfluenzaA__ABI20873
augaaccccaaccagaagaucaucaccaucggcuccaucuccauggccaucggcaucaucucccucacccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccgagaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccaccgccugccacgacggcaucggcuggcucaccaucggcaucuccggccccgacaacggcgccgucgccguccucaaguacaacggcgucaucaccgagaccaucaaguccuggaagaagcagauccuccgcacccaggaguccgagugcgucugcgucaacggcuccugcuucaccaucaugaccgacggccccuccaacggcgccgccuccuaccgcaucuucaagaucgagaagggcaagaucaccaaguccaucgagcucgacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaucaucugggaccccaacggcuggaccgacaccgacuccgacuucuccgucaagcaggacgucgucgccaugaccgacugguccggcuacuccggcuccuucguccagcaccccgagcucaccggccucgacugcaugcgccccugcuucugggucgagcucguccgcggccucccccgcgagaacgccaccaucuggaccuccggcuccuccaucuccuucugcggcgucaacuccgacaccgccaacugguccuggcccgacggcgccgagcuccccuucaccaucgacaaguga

SEQ ID NO: 106816 - RNA, 1410 nt, Artificial Sequence; identical to SEQ ID NO: 106612
  derived and/or modified sequence opt2 from neuraminidase__InfluenzaA__ABI20895

SEQ ID NO: 106817 - RNA, 1410 nt, Artificial Sequence; identical to SEQ ID NO: 106625
  derived and/or modified sequence opt2 from neuraminidase__InfluenzaA__ABI20906

SEQ ID NO: 106818 - RNA, 1410 nt, Artificial Sequence; identical to SEQ ID NO: 106613
  derived and/or modified sequence opt2 from neuraminidase__InfluenzaA__ABI20928

SEQ ID NO: 106819 - RNA, 1410 nt, Artificial Sequence; identical to SEQ ID NO: 106613
  derived and/or modified sequence opt2 from neuraminidase__InfluenzaA__ABI20939

SEQ ID NO: 106820 - RNA, 1410 nt, Artificial Sequence; identical to SEQ ID NO: 106613
  derived and/or modified sequence opt2 from neuraminidase__InfluenzaA__ABI20950

SEQ ID NO: 106821 - RNA, 1410 nt, Artificial Sequence; identical to SEQ ID NO: 106613
  derived and/or modified sequence opt2 from neuraminidase__InfluenzaA__ABI20961

SEQ ID NO: 106822 - RNA, 1410 nt, Artificial Sequence; identical to SEQ ID NO: 106339
  derived and/or modified sequence opt2 from neuraminidase__InfluenzaA__ABI20983

SEQ ID NO: 106823 - RNA, 1410 nt, Artificial Sequence
  derived and/or modified sequence opt2 from neuraminidase__InfluenzaA__ABI20994
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106824 - RNA, 1410 nt, Artificial Sequence
  derived and/or modified sequence opt2 from neuraminidase__InfluenzaA__ABI21005
augaaccccaaccagaagaucaucaccaucggcuccgucucccucaccaucgccaccaucugcuuccucaugcagaucgccguccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgccgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106825 - RNA, 1410 nt, Artificial Sequence; identical to SEQ ID NO: 105666
  derived and/or modified sequence opt2 from neuraminidase__InfluenzaA__ABI21016

SEQ ID NO: 106826 - RNA, 1410 nt, Artificial Sequence
  derived and/or modified sequence opt2 from neuraminidase__InfluenzaA__ABI21027
augaaccccaaccagcgcaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcacccccggcaccuacggcaccggcuccuggcccgacggcgccgacaucaaccucaugcccaucuga

SEQ ID NO: 106827 - RNA, 1410 nt, Artificial Sequence; identical to SEQ ID NO: 106103
  derived and/or modified sequence opt2 from neuraminidase__InfluenzaA__ABI21038

SEQ ID NO: 106828 - RNA, 1410 nt, Artificial Sequence
  derived and/or modified sequence opt2 from neuraminidase__InfluenzaA__ABI21049
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccggcuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106829 - RNA, 1410 nt, Artificial Sequence
  derived and/or modified sequence opt2 from neuraminidase__InfluenzaA__ABI21060
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcccgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106830 - RNA, 1410 nt, Artificial Sequence
  derived and/or modified sequence opt2 from neuraminidase__InfluenzaA__ABI21071
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucauguccgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106831 - RNA, 1410 nt, Artificial Sequence
  derived and/or modified sequence opt2 from neuraminidase__InfluenzaA__ABI21082
augaaccccaaccagaagaucaucaccaucggcuccgucucccucaccaucuccaccaucugcuucuucaugcagaucgccacccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106832 - RNA, 1410 nt, Artificial Sequence; identical to SEQ ID NO: 106248
  derived and/or modified sequence opt2 from neuraminidase__InfluenzaA__ABI21093

SEQ ID NO: 106833 - RNA, 1410 nt, Artificial Sequence
  derived and/or modified sequence opt2 from neuraminidase__InfluenzaA__ABI21104
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucgccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106834 - RNA, 1410 nt, Artificial Sequence; identical to SEQ ID NO: 105839
  derived and/or modified sequence opt2 from neuraminidase__InfluenzaA__ABI21115

SEQ ID NO: 106835 - RNA, 1410 nt, Artificial Sequence; identical to SEQ ID NO: 105839
  derived and/or modified sequence opt2 from neuraminidase__InfluenzaA__ABI21126

SEQ ID NO: 106836 - RNA, 1410 nt, Artificial Sequence; identical to SEQ ID NO: 106248
  derived and/or modified sequence opt2 from neuraminidase__InfluenzaA__ABI21137

SEQ ID NO: 106837 - RNA, 1410 nt, Artificial Sequence; identical to SEQ ID NO: 105839
  derived and/or modified sequence opt2 from neuraminidase__InfluenzaA__ABI21148

SEQ ID NO: 106838 - RNA, 1410 nt, Artificial Sequence
  derived and/or modified sequence opt2 from neuraminidase__InfluenzaA__ABI21159
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccggcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106839 - RNA, 1410 nt, Artificial Sequence; identical to SEQ ID NO: 105839
  derived and/or modified sequence opt2 from neuraminidase__InfluenzaA__ABI21170

SEQ ID NO: 106840 - RNA, 1410 nt, Artificial Sequence; identical to SEQ ID NO: 105839
  derived and/or modified sequence opt2 from neuraminidase__InfluenzaA__ABI21181

SEQ ID NO: 106841 - RNA, 1413 nt, Artificial Sequence
  derived and/or modified sequence opt2 from neuraminidase__InfluenzaA__ABI21192
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaccugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaucaucgacaaguga

SEQ ID NO: 106842 - RNA, 1413 nt, Artificial Sequence; identical to SEQ ID NO: 105898
  derived and/or modified sequence opt2 from neuraminidase__InfluenzaA__ABI21203

SEQ ID NO: 106843 - RNA, 1413 nt, Artificial Sequence
  derived and/or modified sequence opt2 from neuraminidase__InfluenzaA__ABI21214
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaucaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 106844 - RNA, 1410 nt, Artificial Sequence
  derived and/or modified sequence opt2 from neuraminidase__InfluenzaA__ABI21247
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaagugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccuccuacugccgcaaccccaacaacgagaagggcucccacggcaugaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106845 - RNA, 1410 nt, Artificial Sequence; identical to SEQ ID NO: 106765
  derived and/or modified sequence opt2 from neuraminidase__InfluenzaA__ABI21258

SEQ ID NO: 106846 - RNA, 1410 nt, Artificial Sequence; identical to SEQ ID NO: 106765
  derived and/or modified sequence opt2 from neuraminidase__InfluenzaA__ABI21269

SEQ ID NO: 106847 - RNA, 1410 nt, Artificial Sequence; identical to SEQ ID NO: 106765
  derived and/or modified sequence opt2 from neuraminidase__InfluenzaA__ABI21280

SEQ ID NO: 106848 - RNA, 1410 nt, Artificial Sequence; identical to SEQ ID NO: 106697
  derived and/or modified sequence opt2 from neuraminidase__InfluenzaA__ABI21302

SEQ ID NO: 106849 - RNA, 1410 nt, Artificial Sequence; identical to SEQ ID NO: 106697
  derived and/or modified sequence opt2 from neuraminidase__InfluenzaA__ABI21313

SEQ ID NO: 106850 - RNA, 1410 nt, Artificial Sequence; identical to SEQ ID NO: 106697
  derived and/or modified sequence opt2 from neuraminidase__InfluenzaA__ABI21324

SEQ ID NO: 106851 - RNA, 1410 nt, Artificial Sequence; identical to SEQ ID NO: 106697
  derived and/or modified sequence opt2 from neuraminidase__InfluenzaA__ABI21335

SEQ ID NO: 106852 - RNA, 1410 nt, Artificial Sequence; identical to SEQ ID NO: 106765
  derived and/or modified sequence opt2 from neuraminidase__InfluenzaA__ABI21346

SEQ ID NO: 106853 - RNA, 1410 nt, Artificial Sequence
  derived and/or modified sequence opt2 from neuraminidase__InfluenzaA__ABI21357
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaagaacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggaggccgaggucugguggaccuccaacuccaucgucgucuucugcggcaccuccggcaccuacggcaccggcuccuggcccgacggcgccgacaucaaccucaugcccaucuga

SEQ ID NO: 106854 - RNA, 1410 nt, Artificial Sequence; identical to SEQ ID NO: 106697
  derived and/or modified sequence opt2 from neuraminidase__InfluenzaA__ABI21368

SEQ ID NO: 106855 - RNA, 1410 nt, Artificial Sequence; identical to SEQ ID NO: 106697
  derived and/or modified sequence opt2 from neuraminidase__InfluenzaA__ABI21379

SEQ ID NO: 106856 - RNA, 1410 nt, Artificial Sequence; identical to SEQ ID NO: 106697
  derived and/or modified sequence opt2 from neuraminidase__InfluenzaA__ABI21390

SEQ ID NO: 106857 - RNA, 1410 nt, Artificial Sequence; identical to SEQ ID NO: 106765
  derived and/or modified sequence opt2 from neuraminidase__InfluenzaA__ABI21401

SEQ ID NO: 106858 - RNA, 1410 nt, Artificial Sequence
  derived and/or modified sequence opt2 from neuraminidase__InfluenzaA__ABI21412
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106859 - RNA, 1410 nt, Artificial Sequence; identical to SEQ ID NO: 106031
  derived and/or modified sequence opt2 from neuraminidase__InfluenzaA__ABI21423

SEQ ID NO: 106860 - RNA, 1410 nt, Artificial Sequence; identical to SEQ ID NO: 106697
  derived and/or modified sequence opt2 from neuraminidase__InfluenzaA__ABI21434

SEQ ID NO: 106861 - RNA, 1410 nt, Artificial Sequence; identical to SEQ ID NO: 106765
  derived and/or modified sequence opt2 from neuraminidase__InfluenzaA__ABI21445

SEQ ID NO: 106862 - RNA, 1410 nt, Artificial Sequence; identical to SEQ ID NO: 106765
  derived and/or modified sequence opt2 from neuraminidase__InfluenzaA__ABI21456

SEQ ID NO: 106863 - RNA, 1410 nt, Artificial Sequence; identical to SEQ ID NO: 106858
  derived and/or modified sequence opt2 from neuraminidase__InfluenzaA__ABI21467

SEQ ID NO: 106864 - RNA, 1410 nt, Artificial Sequence; identical to SEQ ID NO: 106765
  derived and/or modified sequence opt2 from neuraminidase__InfluenzaA__ABI21478

SEQ ID NO: 106865 - RNA, 1410 nt, Artificial Sequence; identical to SEQ ID NO: 106765
  derived and/or modified sequence opt2 from neuraminidase__InfluenzaA__ABI21489

SEQ ID NO: 106866 - RNA, 1410 nt, Artificial Sequence; identical to SEQ ID NO: 106765
  derived and/or modified sequence opt2 from neuraminidase__InfluenzaA__ABI21500

SEQ ID NO: 106867 - RNA, 1410 nt, Artificial Sequence
  derived and/or modified sequence opt2 from neuraminidase__InfluenzaA__ABI21511
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaugugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106868 - RNA, 1413 nt, Artificial Sequence
  derived and/or modified sequence opt2 from neuraminidase__InfluenzaA__ABI21533
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucaugcgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaucaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106869 - RNA, 1413 nt, Artificial Sequence; identical to SEQ ID NO: 106868
  derived and/or modified sequence opt2 from neuraminidase__InfluenzaA__ABI21544

SEQ ID NO: 106870 - RNA, 1413 nt, Artificial Sequence; identical to SEQ ID NO: 106868
  derived and/or modified sequence opt2 from neuraminidase__InfluenzaA__ABI21555

SEQ ID NO: 106871 - RNA, 1413 nt, Artificial Sequence; identical to SEQ ID NO: 106868
  derived and/or modified sequence opt2 from neuraminidase__InfluenzaA__ABI21566

SEQ ID NO: 106872 - RNA, 1413 nt, Artificial Sequence; identical to SEQ ID NO: 106868
  derived and/or modified sequence opt2 from neuraminidase__InfluenzaA__ABI21577

SEQ ID NO: 106873 - RNA, 1413 nt, Artificial Sequence
  derived and/or modified sequence opt2 from neuraminidase__InfluenzaA__ABI22112
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacgagaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 106874 - RNA, 1410 nt, Artificial Sequence
  derived and/or modified sequence opt2 from neuraminidase__InfluenzaA__ABI22162
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucgaccucaugcccaucuga

SEQ ID NO: 106875 - RNA, 1350 nt, Artificial Sequence
  derived and/or modified sequence opt2 from neuraminidase__InfluenzaA__ABI23981
augaaccccaaccagaagaucaucaccaucggcuccaucugcauggucaucggcaucgucucccucaugcuccagaucggcaacaugaucuccaucugggucucccacuccauccagaccggcaaccagcgccaggccgaguccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccucccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccucaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106876 - RNA, 1410 nt, Artificial Sequence; identical to SEQ ID NO: 105839
  derived and/or modified sequence opt2 from neuraminidase__InfluenzaA__ABI26649

SEQ ID NO: 106877 - RNA, 1413 nt, Artificial Sequence; identical to SEQ ID NO: 106562
  derived and/or modified sequence opt2 from neuraminidase__InfluenzaA__ABI30370

SEQ ID NO: 106878 - RNA, 1410 nt, Artificial Sequence; identical to SEQ ID NO: 106613
  derived and/or modified sequence opt2 from neuraminidase__InfluenzaA__ABI30392

SEQ ID NO: 106879 - RNA, 1410 nt, Artificial Sequence; identical to SEQ ID NO: 106242
  derived and/or modified sequence opt2 from neuraminidase__InfluenzaA__ABI30403

SEQ ID NO: 106880 - RNA, 1410 nt, Artificial Sequence; identical to SEQ ID NO: 106242
  derived and/or modified sequence opt2 from neuraminidase__InfluenzaA__ABI30414

SEQ ID NO: 106881 - RNA, 1410 nt, Artificial Sequence; identical to SEQ ID NO: 105839
  derived and/or modified sequence opt2 from neuraminidase__InfluenzaA__ABI30425

SEQ ID NO: 106882 - RNA, 1410 nt, Artificial Sequence; identical to SEQ ID NO: 105839
  derived and/or modified sequence opt2 from neuraminidase__InfluenzaA__ABI30436

SEQ ID NO: 106883 - RNA, 1410 nt, Artificial Sequence; identical to SEQ ID NO: 105839
  derived and/or modified sequence opt2 from neuraminidase__InfluenzaA__ABI30447

SEQ ID NO: 106884 - RNA, 1410 nt, Artificial Sequence; identical to SEQ ID NO: 105839
  derived and/or modified sequence opt2 from neuraminidase__InfluenzaA__ABI30458

SEQ ID NO: 106885 - RNA, 1410 nt, Artificial Sequence; identical to SEQ ID NO: 105839
  derived and/or modified sequence opt2 from neuraminidase__InfluenzaA__ABI30469

SEQ ID NO: 106886 - RNA, 1410 nt, Artificial Sequence; identical to SEQ ID NO: 105839
  derived and/or modified sequence opt2 from neuraminidase__InfluenzaA__ABI30480

SEQ ID NO: 106887 - RNA, 1410 nt, Artificial Sequence
  derived and/or modified sequence opt2 from neuraminidase__InfluenzaA__ABI30491
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccaagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106888 - RNA, 1410 nt, Artificial Sequence; identical to SEQ ID NO: 105839
  derived and/or modified sequence opt2 from neuraminidase__InfluenzaA__ABI30502

SEQ ID NO: 106889 - RNA, 1410 nt, Artificial Sequence
  derived and/or modified sequence opt2 from neuraminidase__InfluenzaA__ABI30513
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106890 - RNA, 1410 nt, Artificial Sequence; identical to SEQ ID NO: 105839
  derived and/or modified sequence opt2 from neuraminidase__InfluenzaA__ABI30524

SEQ ID NO: 106891 - RNA, 1410 nt, Artificial Sequence; identical to SEQ ID NO: 105839
  derived and/or modified sequence opt2 from neuraminidase__InfluenzaA__ABI30535

SEQ ID NO: 106892 - RNA, 1410 nt, Artificial Sequence
  derived and/or modified sequence opt2 from neuraminidase__InfluenzaA__ABI30546
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccuccacuccaacgacaccguccacgaccgcacccccuaccgcacccuccucauguccgagcucggcguccccuuccaccucggcaccaagcaggucugcaucgccugguccuccuccuccugccacgacggcaaggccuggaugcacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106893 - RNA, 1410 nt, Artificial Sequence; identical to SEQ ID NO: 105839
  derived and/or modified sequence opt2 from neuraminidase__InfluenzaA__ABI30557

SEQ ID NO: 106894 - RNA, 1410 nt, Artificial Sequence; identical to SEQ ID NO: 106226
  derived and/or modified sequence opt2 from neuraminidase__InfluenzaA__ABI30579

SEQ ID NO: 106895 - RNA, 1410 nt, Artificial Sequence
  derived and/or modified sequence opt2 from neuraminidase__InfluenzaA__ABI30590
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaagggcugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106896 - RNA, 1410 nt, Artificial Sequence; identical to SEQ ID NO: 106319
  derived and/or modified sequence opt2 from neuraminidase__InfluenzaA__ABI30601

SEQ ID NO: 106897 - RNA, 1410 nt, Artificial Sequence
  derived and/or modified sequence opt2 from neuraminidase__InfluenzaA__ABI30612
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106898 - RNA, 1410 nt, Artificial Sequence; identical to SEQ ID NO: 106319
  derived and/or modified sequence opt2 from neuraminidase__InfluenzaA__ABI30623

SEQ ID NO: 106899 - RNA, 1410 nt, Artificial Sequence
  derived and/or modified sequence opt2 from neuraminidase__InfluenzaA__ABI30736
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccgucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106900 - RNA, 1410 nt, Artificial Sequence
  derived and/or modified sequence opt2 from neuraminidase__InfluenzaA__ABI30758
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucuacgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106901 - RNA, 1410 nt, Artificial Sequence; identical to SEQ ID NO: 106226
  derived and/or modified sequence opt2 from neuraminidase__InfluenzaA__ABI30769

SEQ ID NO: 106902 - RNA, 1410 nt, Artificial Sequence; identical to SEQ ID NO: 106226
  derived and/or modified sequence opt2 from neuraminidase__InfluenzaA__ABI30780

SEQ ID NO: 106903 - RNA, 1410 nt, Artificial Sequence; identical to SEQ ID NO: 106226
  derived and/or modified sequence opt2 from neuraminidase__InfluenzaA__ABI30791

SEQ ID NO: 106904 - RNA, 1410 nt, Artificial Sequence; identical to SEQ ID NO: 106226
  derived and/or modified sequence opt2 from neuraminidase__InfluenzaA__ABI30802

SEQ ID NO: 106905 - RNA, 1410 nt, Artificial Sequence; identical to SEQ ID NO: 106226
  derived and/or modified sequence opt2 from neuraminidase__InfluenzaA__ABI30813

SEQ ID NO: 106906 - RNA, 1410 nt, Artificial Sequence; identical to SEQ ID NO: 106226
  derived and/or modified sequence opt2 from neuraminidase__InfluenzaA__ABI30824

SEQ ID NO: 106907 - RNA, 1410 nt, Artificial Sequence; identical to SEQ ID NO: 106226
  derived and/or modified sequence opt2 from neuraminidase__InfluenzaA__ABI30835

SEQ ID NO: 106908 - RNA, 1410 nt, Artificial Sequence; identical to SEQ ID NO: 106226
  derived and/or modified sequence opt2 from neuraminidase__InfluenzaA__ABI30846

SEQ ID NO: 106909 - RNA, 1410 nt, Artificial Sequence; identical to SEQ ID NO: 106697
  derived and/or modified sequence opt2 from neuraminidase__InfluenzaA__ABI30857

SEQ ID NO: 106910 - RNA, 1410 nt, Artificial Sequence; identical to SEQ ID NO: 106697
  derived and/or modified sequence opt2 from neuraminidase__InfluenzaA__ABI30868

SEQ ID NO: 106911 - RNA, 1350 nt, Artificial Sequence
  derived and/or modified sequence opt2 from neuraminidase__InfluenzaA__ABI36157
augaaccccaaccagaagaucaucaccaucggcuccaucugcauggccaucggcaccgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccacuccgagugccgcaccuucuuccucacccagggcgcccuccucaacgacaagcacuccaacgagaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccauguccuccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106912 - RNA, 1350 nt, Artificial Sequence; identical to SEQ ID NO: 106911
  derived and/or modified sequence opt2 from neuraminidase__InfluenzaA__ABI36168

SEQ ID NO: 106913 - RNA, 1350 nt, Artificial Sequence; identical to SEQ ID NO: 106911
  derived and/or modified sequence opt2 from neuraminidase__InfluenzaA__ABI36179

SEQ ID NO: 106914 - RNA, 1350 nt, Artificial Sequence; identical to SEQ ID NO: 106911
  derived and/or modified sequence opt2 from neuraminidase__InfluenzaA__ABI36189

SEQ ID NO: 106915 - RNA, 1350 nt, Artificial Sequence
  derived and/or modified sequence opt2 from neuraminidase__InfluenzaA__ABI36278
augaaccccaaccagaagaucaucaccaucggcuccaucugcauggucaucggcaucgucucccucaugcuccagaucggcaacaugaucuccaucugggucucccacuccauccagaagggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106916 - RNA, 1350 nt, Artificial Sequence; identical to SEQ ID NO: 106915
  derived and/or modified sequence opt2 from neuraminidase__InfluenzaA__ABI36287

SEQ ID NO: 106917 - RNA, 1350 nt, Artificial Sequence; identical to SEQ ID NO: 106915
  derived and/or modified sequence opt2 from neuraminidase__InfluenzaA__ABI36298

SEQ ID NO: 106918 - RNA, 1350 nt, Artificial Sequence
  derived and/or modified sequence opt2 from neuraminidase__InfluenzaA__ABI36314
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaacuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106919 - RNA, 1350 nt, Artificial Sequence
  derived and/or modified sequence opt2 from neuraminidase__InfluenzaA__ABI36336
augaaccccaaccagaagaucaucaccaucggcuccaucugcauggucaucggcaucgucucccucaugcuccagaucggcaacaugaucuccaucugggucucccacuccguccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugcccccucggcgaggcccccucccccuacaacucccgcuucgaguccgucuccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccaucaucuccuucugcggcgucaacuccgacaccgucuccugguccuggcccgacggcgccgagcuccccuucaccaucgacaaguga

SEQ ID NO: 106920 - RNA, 1350 nt, Artificial Sequence
  derived and/or modified sequence opt2 from neuraminidase__InfluenzaA__ABI36358
augaaccccaaccagaagaucaucaccaucggcuccaucugcauggucaucggcaucgucucccucaugcuccagaucggcaacaugaucuccaucugggucucccacuccguccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106921 - RNA, 1350 nt, Artificial Sequence; identical to SEQ ID NO: 106911
  derived and/or modified sequence opt2 from neuraminidase__InfluenzaA__ABI36369

SEQ ID NO: 106922 - RNA, 1350 nt, Artificial Sequence
  derived and/or modified sequence opt2 from neuraminidase__InfluenzaA__ABI36391
augaaccccaaccagaagaucaucaccaucggcuccaucugcauggucaucggcaucgucucccucaugcuccagaucggcaacaugaucuccaucugggucucccacuccacccagaagggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcaucuucggcgacaacccccgccccaacgacggcaccggcuccugcggccccauguuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106923 - RNA, 1350 nt, Artificial Sequence; identical to SEQ ID NO: 106922
  derived and/or modified sequence opt2 from neuraminidase__InfluenzaA__ABI36402

SEQ ID NO: 106924 - RNA, 1350 nt, Artificial Sequence; identical to SEQ ID NO: 106911
  derived and/or modified sequence opt2 from neuraminidase__InfluenzaA__ABI36413

SEQ ID NO: 106925 - RNA, 1350 nt, Artificial Sequence
  derived and/or modified sequence opt2 from neuraminidase__InfluenzaA__ABI36446
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccuggaucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106926 - RNA, 1350 nt, Artificial Sequence; identical to SEQ ID NO: 106915
  derived and/or modified sequence opt2 from neuraminidase__InfluenzaA__ABI36457

SEQ ID NO: 106927 - RNA, 1350 nt, Artificial Sequence
  derived and/or modified sequence opt2 from neuraminidase__InfluenzaA__ABI36476
augaaccccaaccagaagaucaucaccaucggcuccaucugcauggucaucggcaucgucucccucaugcuccagaucggcaacaugaucuccaucugggucucccacuccacccagaagggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106928 - RNA, 1350 nt, Artificial Sequence
  derived and/or modified sequence opt2 from neuraminidase__InfluenzaA__ABI49409
augaaccccaaccgcaagaucaucaccaucggcuccaucugcauggucaucggcauggucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgucgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgccuccugguccuggcccgacggcgccgagcuccccuucaccaucgacaaguga

SEQ ID NO: 106929 - RNA, 1350 nt, Artificial Sequence
  derived and/or modified sequence opt2 from neuraminidase__InfluenzaA__ABI49417
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccgcggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccagcccaaggaguccaccaucuggaccuccggcuccuccaucuccuucugcggcgucaacuccgacaccgucuccugguccuggcccgacggcgccgagcuccccuucaccaucgacaaguga

SEQ ID NO: 106930 - RNA, 1410 nt, Artificial Sequence
  derived and/or modified sequence opt2 from neuraminidase__InfluenzaA__ABI84962
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 106931 - RNA, 1410 nt, Artificial Sequence
  derived and/or modified sequence opt2 from neuraminidase__InfluenzaA__ABI85003
augaaccccaaccagaagaucaucaccaucggcgucgucaacaccacccucuccaccaucgcccuccucaucggcgucggcaaccucgucuucaacaccgucauccacgagaagaucggcgaccaccagaucgucacccaccccaccaucaugacccccgagguccccaacugcuccgacaccaucaucaccuacaacaacaccgucaucaacaacaucaccaccaccaucaucaccgaggccgagcgccccuucaaguccccccucccccucugccccuuccgcggcuucuuccccuuccacaaggacaacgccauccgccucggcgagaacaaggacgucaucgucacccgcgagcccuacgucuccugcgacaacgacaacugcugguccuucgcccucgcccagggcgcccuccucggcaccaagcacuccaacggcaccaucaaggaccgcacccccuaccgcucccucauccgcuuccccaucggcaccgcccccguccucggcaacuacaaggagaucugcaucgccugguccuccuccuccugcuucgacggcaaggaguggaugcacgucugcaugaccggcaacgacaacgacgccuccgcccagaucaucuacggcggccgcaugaccgacuccaucaaguccuggcgcaaggacauccuccgcacccaggaguccgagugccagugcaucgacggcaccugcgucgucgccgucaccgacggccccgccgccaacuccgccgaccaccgcgucuacuggauccgcgagggccgcaucaucaaguacgagaacguccccaagaccaagauccagcaccucgaggagugcuccugcuacgucgacaucgacgucuacugcaucugccgcgacaacuggaagggcuccaaccgccccuggaugcgcaucaacaacgagaccauccucgagaccggcuacgucugcuccaaguuccacuccgacaccccccgccccgccgaccccuccaucauguccugcgacucccccuccaacgucaacggcggccccggcgucaagggcuucggcuucaaggccggcaacgacgucuggcucggccgcaccgucuccaccuccggccgcuccggcuucgagaucaucaaggucaccgagggcuggaucaacucccccaaccacgucaaguccaucacccagacccucgucuccaacaacgacugguccggcuacuccggcuccuucaucgucaaggccaaggacugcuuccagcccugcuucuacgucgagcucauccgcggccgccccaacaagaacgacgacgucuccuggaccuccaacuccaucgucaccuucugcggccucgacaacgagcccggcuccggcaacuggcccgacggcuccaacaucggcuucaugcccaaguga

SEQ ID NO: 106932 - RNA, 1410 nt, Artificial Sequence; identical to SEQ ID NO: 106602
  derived and/or modified sequence opt2 from neuraminidase__InfluenzaA__ABI92294

SEQ ID NO: 106933 - RNA, 1413 nt, Artificial Sequence
  derived and/or modified sequence opt2 from neuraminidase__InfluenzaA__ABI92305
augaaccccaaccagaagaucaucaccaucggcuccaucugcauggccaucggcaucaucucccucauccuccagaucggcaacaucaucuccaucugggucucccaccucauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccguccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcaucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 106934 - RNA, 1413 nt, Artificial Sequence
  derived and/or modified sequence opt2 from neuraminidase__InfluenzaA__ABI92316
augaaccccaaccagaagaucaucaccaucggcuccaucuccaucgccaucggcgucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 106935 - RNA, 1410 nt, Artificial Sequence; identical to SEQ ID NO: 106613
  derived and/or modified sequence opt2 from neuraminidase__InfluenzaA__ABI92327

SEQ ID NO: 106936 - RNA, 1410 nt, Artificial Sequence
  derived and/or modified sequence opt2 from neuraminidase__InfluenzaA__ABI92338
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucaucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106937 - RNA, 1410 nt, Artificial Sequence
  derived and/or modified sequence opt2 from neuraminidase__InfluenzaA__ABI92349
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccaaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaucggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106938 - RNA, 1410 nt, Artificial Sequence; identical to SEQ ID NO: 105839
  derived and/or modified sequence opt2 from neuraminidase__InfluenzaA__ABI92360

SEQ ID NO: 106939 - RNA, 1410 nt, Artificial Sequence; identical to SEQ ID NO: 105839
  derived and/or modified sequence opt2 from neuraminidase__InfluenzaA__ABI92371

SEQ ID NO: 106940 - RNA, 1413 nt, Artificial Sequence; identical to SEQ ID NO: 105898
  derived and/or modified sequence opt2 from neuraminidase__InfluenzaA__ABI92382

SEQ ID NO: 106941 - RNA, 1410 nt, Artificial Sequence; identical to SEQ ID NO: 106226
  derived and/or modified sequence opt2 from neuraminidase__InfluenzaA__ABI92393

SEQ ID NO: 106942 - RNA, 1410 nt, Artificial Sequence; identical to SEQ ID NO: 105839
  derived and/or modified sequence opt2 from neuraminidase__InfluenzaA__ABI92404

SEQ ID NO: 106943 - RNA, 1410 nt, Artificial Sequence
  derived and/or modified sequence opt2 from neuraminidase__InfluenzaA__ABI92415
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaacuucaugcccaucuga

SEQ ID NO: 106944 - RNA, 1410 nt, Artificial Sequence; identical to SEQ ID NO: 106226
  derived and/or modified sequence opt2 from neuraminidase__InfluenzaA__ABI92426

SEQ ID NO: 106945 - RNA, 1410 nt, Artificial Sequence; identical to SEQ ID NO: 106226
  derived and/or modified sequence opt2 from neuraminidase__InfluenzaA__ABI92437

SEQ ID NO: 106946 - RNA, 1410 nt, Artificial Sequence; identical to SEQ ID NO: 106226
  derived and/or modified sequence opt2 from neuraminidase__InfluenzaA__ABI92448

SEQ ID NO: 106947 - RNA, 1410 nt, Artificial Sequence; identical to SEQ ID NO: 106226
  derived and/or modified sequence opt2 from neuraminidase__InfluenzaA__ABI92459

SEQ ID NO: 106948 - RNA, 1410 nt, Artificial Sequence
  derived and/or modified sequence opt2 from neuraminidase__InfluenzaA__ABI92470
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccgagaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106949 - RNA, 1410 nt, Artificial Sequence; identical to SEQ ID NO: 106242
  derived and/or modified sequence opt2 from neuraminidase__InfluenzaA__ABI92481

SEQ ID NO: 106950 - RNA, 1410 nt, Artificial Sequence; identical to SEQ ID NO: 106242
  derived and/or modified sequence opt2 from neuraminidase__InfluenzaA__ABI92492

SEQ ID NO: 106951 - RNA, 1410 nt, Artificial Sequence
  derived and/or modified sequence opt2 from neuraminidase__InfluenzaA__ABI92503
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgaggaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 106952 - RNA, 1410 nt, Artificial Sequence
  derived and/or modified sequence opt2 from neuraminidase__InfluenzaA__ABI92514
augaaccccaaccagaagaucaucaccaucggcuccgucucccucaccaucgccaccaucugcuuccucguccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcgacgacgucuggaugggccgcaccaucuccgagaagucccgcuccggcuacgagaccuucaaggucaucgagggcugguccaagcccaacuccaagcuccagaucaaccgccaggucaucgucgagcgcggcaacauguccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 106953 - RNA, 1410 nt, Artificial Sequence
  derived and/or modified sequence opt2 from neuraminidase__InfluenzaA__ABI92525
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106954 - RNA, 1410 nt, Artificial Sequence
  derived and/or modified sequence opt2 from neuraminidase__InfluenzaA__ABI92536
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaagugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcgccggcuccuggcccgacggcgccgacaucaaccucaugcccaucuga

SEQ ID NO: 106955 - RNA, 1410 nt, Artificial Sequence
  derived and/or modified sequence opt2 from neuraminidase__InfluenzaA__ABI92547
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcgccggcuccuggcccgacggcgccgacaucaaccucaugcccaucuga

SEQ ID NO: 106956 - RNA, 1410 nt, Artificial Sequence
  derived and/or modified sequence opt2 from neuraminidase__InfluenzaA__ABI92558
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacuggucccgcccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106957 - RNA, 1410 nt, Artificial Sequence
  derived and/or modified sequence opt2 from neuraminidase__InfluenzaA__ABI92569
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggcaagcucgucgacuccaucggcuccugguccaagaagauccuccgcacccaggaguccgagugcgucugcaucaacggcaccugcgccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106958 - RNA, 1410 nt, Artificial Sequence
  derived and/or modified sequence opt2 from neuraminidase__InfluenzaA__ABI92580
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaacaaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaagggcugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106959 - RNA, 1410 nt, Artificial Sequence
  derived and/or modified sequence opt2 from neuraminidase__InfluenzaA__ABI92591
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccuccgcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacucccucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaagggcugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106960 - RNA, 1410 nt, Artificial Sequence
  derived and/or modified sequence opt2 from neuraminidase__InfluenzaA__ABI92602
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccucccucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccaggucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106961 - RNA, 1410 nt, Artificial Sequence
  derived and/or modified sequence opt2 from neuraminidase__InfluenzaA__ABI92613
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacaacgagaacgccaccgccuccuucaucuacaacggcaagcucgucgacuccaucggcuccugguccaagaagauccuccgcacccaggaguccgagugcgucugcaucaacggcaccugcgccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106962 - RNA, 1410 nt, Artificial Sequence
  derived and/or modified sequence opt2 from neuraminidase__InfluenzaA__ABI92624
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucauccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106963 - RNA, 1410 nt, Artificial Sequence
  derived and/or modified sequence opt2 from neuraminidase__InfluenzaA__ABI92635
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaaccucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagaucaucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106964 - RNA, 1410 nt, Artificial Sequence; identical to SEQ ID NO: 105657
  derived and/or modified sequence opt2 from neuraminidase__InfluenzaA__ABI92646

SEQ ID NO: 106965 - RNA, 1410 nt, Artificial Sequence; identical to SEQ ID NO: 105657
  derived and/or modified sequence opt2 from neuraminidase__InfluenzaA__ABI92657

SEQ ID NO: 106966 - RNA, 1410 nt, Artificial Sequence
  derived and/or modified sequence opt2 from neuraminidase__InfluenzaA__ABI92668
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106967 - RNA, 1410 nt, Artificial Sequence; identical to SEQ ID NO: 106103
  derived and/or modified sequence opt2 from neuraminidase__InfluenzaA__ABI92679

SEQ ID NO: 106968 - RNA, 1410 nt, Artificial Sequence; identical to SEQ ID NO: 105657
  derived and/or modified sequence opt2 from neuraminidase__InfluenzaA__ABI92701

SEQ ID NO: 106969 - RNA, 1410 nt, Artificial Sequence
  derived and/or modified sequence opt2 from neuraminidase__InfluenzaA__ABI92712
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggccaugcucugcgagcccaccaccaccgagcgcaacaccaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106970 - RNA, 1410 nt, Artificial Sequence
  derived and/or modified sequence opt2 from neuraminidase__InfluenzaA__ABI92723
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106971 - RNA, 1410 nt, Artificial Sequence; identical to SEQ ID NO: 105657
  derived and/or modified sequence opt2 from neuraminidase__InfluenzaA__ABI92734

SEQ ID NO: 106972 - RNA, 1410 nt, Artificial Sequence; identical to SEQ ID NO: 106103
  derived and/or modified sequence opt2 from neuraminidase__InfluenzaA__ABI92745

SEQ ID NO: 106973 - RNA, 1410 nt, Artificial Sequence
  derived and/or modified sequence opt2 from neuraminidase__InfluenzaA__ABI92756
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucauccucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106974 - RNA, 1410 nt, Artificial Sequence
  derived and/or modified sequence opt2 from neuraminidase__InfluenzaA__ABI92767
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggagaagaccgaggucugguggaccuccaacuccaucgucgucuucugcggcaccuccggcaccuacggcaccggcuccuggcccgacggcgccgacaucaaccucaugcccaucuga

SEQ ID NO: 106975 - RNA, 1410 nt, Artificial Sequence; identical to SEQ ID NO: 105657
  derived and/or modified sequence opt2 from neuraminidase__InfluenzaA__ABI92778

SEQ ID NO: 106976 - RNA, 1410 nt, Artificial Sequence; identical to SEQ ID NO: 105839
  derived and/or modified sequence opt2 from neuraminidase__InfluenzaA__ABI92789

SEQ ID NO: 106977 - RNA, 1410 nt, Artificial Sequence; identical to SEQ ID NO: 105839
  derived and/or modified sequence opt2 from neuraminidase__InfluenzaA__ABI92800

SEQ ID NO: 106978 - RNA, 1410 nt, Artificial Sequence; identical to SEQ ID NO: 105839
  derived and/or modified sequence opt2 from neuraminidase__InfluenzaA__ABI92811

SEQ ID NO: 106979 - RNA, 1410 nt, Artificial Sequence; identical to SEQ ID NO: 105839
  derived and/or modified sequence opt2 from neuraminidase__InfluenzaA__ABI92822

SEQ ID NO: 106980 - RNA, 1410 nt, Artificial Sequence; identical to SEQ ID NO: 105839
  derived and/or modified sequence opt2 from neuraminidase__InfluenzaA__ABI92844

SEQ ID NO: 106981 - RNA, 1410 nt, Artificial Sequence; identical to SEQ ID NO: 105839
  derived and/or modified sequence opt2 from neuraminidase__InfluenzaA__ABI92855

SEQ ID NO: 106982 - RNA, 1410 nt, Artificial Sequence
  derived and/or modified sequence opt2 from neuraminidase__InfluenzaA__ABI92866
augaaccccaaccagaagaucaucaccaucggcuccgccucccucaccaucgccaccaucugcuuccucauccagaucgccauccucgucaccaccgucacccuccacuucaagcagcacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucuccuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 106983 - RNA, 1410 nt, Artificial Sequence; identical to SEQ ID NO: 105839
  derived and/or modified sequence opt2 from neuraminidase__InfluenzaA__ABI92877

SEQ ID NO: 106984 - RNA, 1410 nt, Artificial Sequence; identical to SEQ ID NO: 105839
  derived and/or modified sequence opt2 from neuraminidase__InfluenzaA__ABI92888

SEQ ID NO: 106985 - RNA, 1410 nt, Artificial Sequence; identical to SEQ ID NO: 105839
  derived and/or modified sequence opt2 from neuraminidase__InfluenzaA__ABI92899

SEQ ID NO: 106986 - RNA, 1410 nt, Artificial Sequence; identical to SEQ ID NO: 105839
  derived and/or modified sequence opt2 from neuraminidase__InfluenzaA__ABI92910

SEQ ID NO: 106987 - RNA, 1410 nt, Artificial Sequence; identical to SEQ ID NO: 105839
  derived and/or modified sequence opt2 from neuraminidase__InfluenzaA__ABI92921

SEQ ID NO: 106988 - RNA, 1410 nt, Artificial Sequence; identical to SEQ ID NO: 105839
  derived and/or modified sequence opt2 from neuraminidase__InfluenzaA__ABI92932

SEQ ID NO: 106989 - RNA, 1410 nt, Artificial Sequence; identical to SEQ ID NO: 106226
  derived and/or modified sequence opt2 from neuraminidase__InfluenzaA__ABI92943

SEQ ID NO: 106990 - RNA, 1410 nt, Artificial Sequence; identical to SEQ ID NO: 106226
  derived and/or modified sequence opt2 from neuraminidase__InfluenzaA__ABI92954

SEQ ID NO: 106991 - RNA, 1410 nt, Artificial Sequence
  derived and/or modified sequence opt2 from neuraminidase__InfluenzaA__ABI92965
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgaccgcuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 106992 - RNA, 1410 nt, Artificial Sequence; identical to SEQ ID NO: 106226
  derived and/or modified sequence opt2 from neuraminidase__InfluenzaA__ABI92976

SEQ ID NO: 106993 - RNA, 1410 nt, Artificial Sequence; identical to SEQ ID NO: 106226
  derived and/or modified sequence opt2 from neuraminidase__InfluenzaA__ABI92987

SEQ ID NO: 106994 - RNA, 1410 nt, Artificial Sequence; identical to SEQ ID NO: 106226
  derived and/or modified sequence opt2 from neuraminidase__InfluenzaA__ABI92998

SEQ ID NO: 106995 - RNA, 1410 nt, Artificial Sequence; identical to SEQ ID NO: 106430
  derived and/or modified sequence opt2 from neuraminidase__InfluenzaA__ABI93009

SEQ ID NO: 106996 - RNA, 1410 nt, Artificial Sequence; identical to SEQ ID NO: 106226
  derived and/or modified sequence opt2 from neuraminidase__InfluenzaA__ABI93020

SEQ ID NO: 106997 - RNA, 1413 nt, Artificial Sequence; identical to SEQ ID NO: 106868
  derived and/or modified sequence opt2 from neuraminidase__InfluenzaA__ABI93031

SEQ ID NO: 106998 - RNA, 1410 nt, Artificial Sequence; identical to SEQ ID NO: 106623
  derived and/or modified sequence opt2 from neuraminidase__InfluenzaA__ABI93042

SEQ ID NO: 106999 - RNA, 1410 nt, Artificial Sequence; identical to SEQ ID NO: 105796
  derived and/or modified sequence opt2 from neuraminidase__InfluenzaA__ABI93053

SEQ ID NO: 107000 - RNA, 1410 nt, Artificial Sequence
  derived and/or modified sequence opt2 from neuraminidase__InfluenzaA__ABI93064
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 107001 - RNA, 1410 nt, Artificial Sequence; identical to SEQ ID NO: 106242
  derived and/or modified sequence opt2 from neuraminidase__InfluenzaA__ABI93075

SEQ ID NO: 107002 - RNA, 1410 nt, Artificial Sequence; identical to SEQ ID NO: 106242
  derived and/or modified sequence opt2 from neuraminidase__InfluenzaA__ABI93086

SEQ ID NO: 107003 - RNA, 1410 nt, Artificial Sequence; identical to SEQ ID NO: 106242
  derived and/or modified sequence opt2 from neuraminidase__InfluenzaA__ABI93097

SEQ ID NO: 107004 - RNA, 1410 nt, Artificial Sequence
  derived and/or modified sequence opt2 from neuraminidase__InfluenzaA__ABI93108
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaacgacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107005 - RNA, 1410 nt, Artificial Sequence
  derived and/or modified sequence opt2 from neuraminidase__InfluenzaA__ABI93119
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacaacuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcuccaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107006 - RNA, 1416 nt, Artificial Sequence
  derived and/or modified sequence opt2 from neuraminidase__InfluenzaA__ABI94584
augaaccccaaccagaagcucuucgcccucuccggcgucgccaucgcccucuccguccucaaccuccucaucggcaucuccaacgucggccucaacgucucccuccaccucaaggagaagggccccaagcaggaggagaaccucaccugcaccaccaucaaccagaacaacaccaccgucgucgagaacaccuacgucaacaacaccaccaucaucaccaagggcaccgaccucaagacccccuccuaccuccuccucaacaagucccucugcaacgucgagggcugggucgucaucgccaaggacaacgccguccgcuucggcgaguccgagcagaucaucgucacccgcgagcccuacgucuccugcgaccccaccggcugcaagauguacgcccuccaccagggcaccaccauccgcaacaagcacuccaacggcaccauccacgaccgcaccgccuuccgcggccucaucuccaccccccucggcaccccccccaccgucuccaacuccgacuucaugugcgucggcugguccuccaccaccugccacgacggcaucgcccgcaugaccaucugcauccagggcaacaacgacaacgccaccgccaccgucuacuacaaccgccgccucaccaccaccaucaagaccugggcccgcaacauccuccgcacccaggaguccgagugcgucugccacaacggcaccugcgccgucgucaugaccgacggcuccgccuccucccaggccuacaccaaggucauguacuuccacaagggccucgucgucaaggaggaggagcuccgcggcuccgcccgccacaucgaggagugcuccugcuacggccacaaccagaaggucaccugcgucugccgcgacaacuggcagggcgccaaccgccccaucaucgagaucgacauguccacccucgagcacaccucccgcuacgucugcaccggcauccucaccgacaccucccgccccggcgacaaguccuccggcgacugcuccaaccccaucaccggcucccccggcguccccggcgucaagggcuucggcuuccucaacggcgacaacaccuggcucggccgcaccaucuccccccgcucccgcuccggcuucgagaugcucaagauccccaacgccggcaccgaccccaacucccgcaucgccgagcgccaggagaucgucgacaacaacaacugguccggcuacuccggcuccuucaucgacuacuggaacgacaacuccgagugcuacaaccccugcuucuacgucgagcucauccgcggccgccccgaggaggccaaguacgucuggugggccuccaacucccucaucgcccucugcggcucccccuuccccgucggcuccggcuccuuccccgacggcgcccagauccaguacuucuccuga

SEQ ID NO: 107007 - RNA, 1413 nt, Artificial Sequence; identical to SEQ ID NO: 106340
  derived and/or modified sequence opt2 from neuraminidase__InfluenzaA__ABI95220

SEQ ID NO: 107008 - RNA, 1410 nt, Artificial Sequence
  derived and/or modified sequence opt2 from neuraminidase__InfluenzaA__ABI95242
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107009 - RNA, 1413 nt, Artificial Sequence
  derived and/or modified sequence opt2 from neuraminidase__InfluenzaA__ABI95253
augaaccccaaccagaagaucaucaccaucggcuccaucuccaucgccaucggcaucaucuccaucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccgacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107010 - RNA, 1413 nt, Artificial Sequence; identical to SEQ ID NO: 106868
  derived and/or modified sequence opt2 from neuraminidase__InfluenzaA__ABI95264

SEQ ID NO: 107011 - RNA, 1413 nt, Artificial Sequence; identical to SEQ ID NO: 106868
  derived and/or modified sequence opt2 from neuraminidase__InfluenzaA__ABI95275

SEQ ID NO: 107012 - RNA, 1413 nt, Artificial Sequence; identical to SEQ ID NO: 106868
  derived and/or modified sequence opt2 from neuraminidase__InfluenzaA__ABI95286

SEQ ID NO: 107013 - RNA, 1413 nt, Artificial Sequence
  derived and/or modified sequence opt2 from neuraminidase__InfluenzaA__ABI95297
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaagaaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 107014 - RNA, 1410 nt, Artificial Sequence; identical to SEQ ID NO: 106242
  derived and/or modified sequence opt2 from neuraminidase__InfluenzaA__ABI95308

SEQ ID NO: 107015 - RNA, 1413 nt, Artificial Sequence; identical to SEQ ID NO: 105898
  derived and/or modified sequence opt2 from neuraminidase__InfluenzaA__ABI96131

SEQ ID NO: 107016 - RNA, 1413 nt, Artificial Sequence; identical to SEQ ID NO: 105898
  derived and/or modified sequence opt2 from neuraminidase__InfluenzaA__ABI96133

SEQ ID NO: 107017 - RNA, 1413 nt, Artificial Sequence; identical to SEQ ID NO: 105898
  derived and/or modified sequence opt2 from neuraminidase__InfluenzaA__ABI96136

SEQ ID NO: 107018 - RNA, 1410 nt, Artificial Sequence
  derived and/or modified sequence opt2 from neuraminidase__InfluenzaA__ABJ09110
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107019 - RNA, 1410 nt, Artificial Sequence; identical to SEQ ID NO: 106613
  derived and/or modified sequence opt2 from neuraminidase__InfluenzaA__ABJ09143

SEQ ID NO: 107020 - RNA, 1413 nt, Artificial Sequence; identical to SEQ ID NO: 106437
  derived and/or modified sequence opt2 from neuraminidase__InfluenzaA__ABJ09154

SEQ ID NO: 107021 - RNA, 1410 nt, Artificial Sequence; identical to SEQ ID NO: 105839
  derived and/or modified sequence opt2 from neuraminidase__InfluenzaA__ABJ09165

SEQ ID NO: 107022 - RNA, 1410 nt, Artificial Sequence; identical to SEQ ID NO: 105839
  derived and/or modified sequence opt2 from neuraminidase__InfluenzaA__ABJ09176

SEQ ID NO: 107023 - RNA, 1410 nt, Artificial Sequence; identical to SEQ ID NO: 106226
  derived and/or modified sequence opt2 from neuraminidase__InfluenzaA__ABJ09198

SEQ ID NO: 107024 - RNA, 1410 nt, Artificial Sequence; identical to SEQ ID NO: 106226
  derived and/or modified sequence opt2 from neuraminidase__InfluenzaA__ABJ09209

SEQ ID NO: 107025 - RNA, 1410 nt, Artificial Sequence
  derived and/or modified sequence opt2 from neuraminidase__InfluenzaA__ABJ09220
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccaaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccgcggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 107026 - RNA, 1410 nt, Artificial Sequence; identical to SEQ ID NO: 106242
  derived and/or modified sequence opt2 from neuraminidase__InfluenzaA__ABJ09231

SEQ ID NO: 107027 - RNA, 1410 nt, Artificial Sequence; identical to SEQ ID NO: 106242
  derived and/or modified sequence opt2 from neuraminidase__InfluenzaA__ABJ09242

SEQ ID NO: 107028 - RNA, 1410 nt, Artificial Sequence; identical to SEQ ID NO: 105796
  derived and/or modified sequence opt2 from neuraminidase__InfluenzaA__ABJ09253

SEQ ID NO: 107029 - RNA, 1410 nt, Artificial Sequence
  derived and/or modified sequence opt2 from neuraminidase__InfluenzaA__ABJ09264
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuacaugaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaacuccuccggcuacuccggcaucuucuccgucgagggcaaguccugcaucaaccgcugcuucuacgucgagcucauccgcggccgcaagcaggagaccgaggucugguggaccuccaacuccaucgucguccucugcggcaccuccggcaccuacggcaccggcuccuggcccgacggcgccgacaucaaccucaugcccaucuga

SEQ ID NO: 107030 - RNA, 1410 nt, Artificial Sequence
  derived and/or modified sequence opt2 from neuraminidase__InfluenzaA__ABJ09286
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaacaagcaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107031 - RNA, 1410 nt, Artificial Sequence; identical to SEQ ID NO: 105796
  derived and/or modified sequence opt2 from neuraminidase__InfluenzaA__ABJ09308

SEQ ID NO: 107032 - RNA, 1410 nt, Artificial Sequence; identical to SEQ ID NO: 107000
  derived and/or modified sequence opt2 from neuraminidase__InfluenzaA__ABJ09319

SEQ ID NO: 107033 - RNA, 1413 nt, Artificial Sequence; identical to SEQ ID NO: 106465
  derived and/or modified sequence opt2 from neuraminidase__InfluenzaA__ABJ09330

SEQ ID NO: 107034 - RNA, 1410 nt, Artificial Sequence
  derived and/or modified sequence opt2 from neuraminidase__InfluenzaA__ABJ09341
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107035 - RNA, 1410 nt, Artificial Sequence
  derived and/or modified sequence opt2 from neuraminidase__InfluenzaA__ABJ09352
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107036 - RNA, 1407 nt, Artificial Sequence
  derived and/or modified sequence opt2 from neuraminidase__InfluenzaA__ABJ09374
augauccaguccaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggcaagaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107037 - RNA, 1410 nt, Artificial Sequence; identical to SEQ ID NO: 106226
  derived and/or modified sequence opt2 from neuraminidase__InfluenzaA__ABJ09385

SEQ ID NO: 107038 - RNA, 1410 nt, Artificial Sequence; identical to SEQ ID NO: 105765
  derived and/or modified sequence opt2 from neuraminidase__InfluenzaA__ABJ16590

SEQ ID NO: 107039 - RNA, 1410 nt, Artificial Sequence; identical to SEQ ID NO: 107030
  derived and/or modified sequence opt2 from neuraminidase__InfluenzaA__ABJ16601

SEQ ID NO: 107040 - RNA, 1413 nt, Artificial Sequence
  derived and/or modified sequence opt2 from neuraminidase__InfluenzaA__ABJ16612
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccgucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107041 - RNA, 1410 nt, Artificial Sequence; identical to SEQ ID NO: 107030
  derived and/or modified sequence opt2 from neuraminidase__InfluenzaA__ABJ16623

SEQ ID NO: 107042 - RNA, 1410 nt, Artificial Sequence
  derived and/or modified sequence opt2 from neuraminidase__InfluenzaA__ABJ16634
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaucaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107043 - RNA, 1413 nt, Artificial Sequence; identical to SEQ ID NO: 105898
  derived and/or modified sequence opt2 from neuraminidase__InfluenzaA__ABJ16656

SEQ ID NO: 107044 - RNA, 1413 nt, Artificial Sequence; identical to SEQ ID NO: 105898
  derived and/or modified sequence opt2 from neuraminidase__InfluenzaA__ABJ16667

SEQ ID NO: 107045 - RNA, 1413 nt, Artificial Sequence
  derived and/or modified sequence opt2 from neuraminidase__InfluenzaA__ABJ16678
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuuccucgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107046 - RNA, 1413 nt, Artificial Sequence; identical to SEQ ID NO: 105898
  derived and/or modified sequence opt2 from neuraminidase__InfluenzaA__ABJ16689

SEQ ID NO: 107047 - RNA, 1410 nt, Artificial Sequence
  derived and/or modified sequence opt2 from neuraminidase__InfluenzaA__ABJ16700
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggcaagaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107048 - RNA, 1410 nt, Artificial Sequence
  derived and/or modified sequence opt2 from neuraminidase__InfluenzaA__ABJ16711
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgccuggaugggccgcaccaucuccgagaagcuccgcuccggcuacgagaccuucaaggucaucgagggcugguccaaguccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107049 - RNA, 1413 nt, Artificial Sequence
  derived and/or modified sequence opt2 from neuraminidase__InfluenzaA__ABJ16733
augaaccccaaccagaagaucaucaccaucggcuccaucuccgucgccaucggcaucaucaaccucauccuccagaucggcaacaucaucuccaucugggccucccacuccauccagaccggcucccagaacuacaccggcaucugcaaccagcgcaucaucaccuacgagaaccgcaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 107050 - RNA, 1410 nt, Artificial Sequence; identical to SEQ ID NO: 106242
  derived and/or modified sequence opt2 from neuraminidase__InfluenzaA__ABJ16744

SEQ ID NO: 107051 - RNA, 1410 nt, Artificial Sequence; identical to SEQ ID NO: 106242
  derived and/or modified sequence opt2 from neuraminidase__InfluenzaA__ABJ16755

SEQ ID NO: 107052 - RNA, 1410 nt, Artificial Sequence; identical to SEQ ID NO: 106242
  derived and/or modified sequence opt2 from neuraminidase__InfluenzaA__ABJ16766

SEQ ID NO: 107053 - RNA, 1410 nt, Artificial Sequence
  derived and/or modified sequence opt2 from neuraminidase__InfluenzaA__ABJ16777
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107054 - RNA, 1410 nt, Artificial Sequence; identical to SEQ ID NO: 106242
  derived and/or modified sequence opt2 from neuraminidase__InfluenzaA__ABJ16788

SEQ ID NO: 107055 - RNA, 1413 nt, Artificial Sequence; identical to SEQ ID NO: 106480
  derived and/or modified sequence opt2 from neuraminidase__InfluenzaA__ABJ53441

SEQ ID NO: 107056 - RNA, 1413 nt, Artificial Sequence
  derived and/or modified sequence opt2 from neuraminidase__InfluenzaA__ABJ53452
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107057 - RNA, 1410 nt, Artificial Sequence; identical to SEQ ID NO: 106224
  derived and/or modified sequence opt2 from neuraminidase__InfluenzaA__ABJ53463

SEQ ID NO: 107058 - RNA, 1410 nt, Artificial Sequence; identical to SEQ ID NO: 106224
  derived and/or modified sequence opt2 from neuraminidase__InfluenzaA__ABJ53474

SEQ ID NO: 107059 - RNA, 1410 nt, Artificial Sequence
  derived and/or modified sequence opt2 from neuraminidase__InfluenzaA__ABJ53485
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaacuccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107060 - RNA, 1413 nt, Artificial Sequence; identical to SEQ ID NO: 106868
  derived and/or modified sequence opt2 from neuraminidase__InfluenzaA__ABJ53496

SEQ ID NO: 107061 - RNA, 1413 nt, Artificial Sequence; identical to SEQ ID NO: 106868
  derived and/or modified sequence opt2 from neuraminidase__InfluenzaA__ABJ53507

SEQ ID NO: 107062 - RNA, 1413 nt, Artificial Sequence
  derived and/or modified sequence opt2 from neuraminidase__InfluenzaA__ABJ53518
augaaccccaaccagaagaucaucaccaucggcuccaucuccgucgccaucggcaucaucaaccucauccuccagaucggcaacaucaucuccaucugggccucccacuccauccagaccggcucccagaacuacaccggcaucugcaaccagcgcaucaucaccuacgagaaccgcaccugggucaaccagaccuacgucaacaucaacaacaccaacgucgucgccggcaaggacaagaccuccaugacccucgccggcaaccucucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 107063 - RNA, 1410 nt, Artificial Sequence; identical to SEQ ID NO: 105666
  derived and/or modified sequence opt2 from neuraminidase__InfluenzaA__ABK39965

SEQ ID NO: 107064 - RNA, 1410 nt, Artificial Sequence
  derived and/or modified sequence opt2 from neuraminidase__InfluenzaA__ABK39976
augaaccccaaccagaagaucaucaccaucggcuccgucucccucaccaucuccaccaccugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107065 - RNA, 1410 nt, Artificial Sequence; identical to SEQ ID NO: 106224
  derived and/or modified sequence opt2 from neuraminidase__InfluenzaA__ABK39987

SEQ ID NO: 107066 - RNA, 1410 nt, Artificial Sequence; identical to SEQ ID NO: 105894
  derived and/or modified sequence opt2 from neuraminidase__InfluenzaA__ABK39998

SEQ ID NO: 107067 - RNA, 1410 nt, Artificial Sequence; identical to SEQ ID NO: 105839
  derived and/or modified sequence opt2 from neuraminidase__InfluenzaA__ABK40020

SEQ ID NO: 107068 - RNA, 1413 nt, Artificial Sequence
  derived and/or modified sequence opt2 from neuraminidase__InfluenzaA__ABK40031
augaaccccaaccagaagaucaucaccaucggcuccaucuccgucgccaucggcaucaucaaccucauccuccagaucggcaacaucaucuccaucugggccucccacuccauccagaccggcucccagaacuacaccggcaucugcaaccagcgcaucaucaccuacgagaaccgcaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 107069 - RNA, 1413 nt, Artificial Sequence; identical to SEQ ID NO: 107068
  derived and/or modified sequence opt2 from neuraminidase__InfluenzaA__ABK40042

SEQ ID NO: 107070 - RNA, 1413 nt, Artificial Sequence; identical to SEQ ID NO: 107068
  derived and/or modified sequence opt2 from neuraminidase__InfluenzaA__ABK40053

SEQ ID NO: 107071 - RNA, 1410 nt, Artificial Sequence; identical to SEQ ID NO: 106242
  derived and/or modified sequence opt2 from neuraminidase__InfluenzaA__ABK40064

SEQ ID NO: 107072 - RNA, 1410 nt, Artificial Sequence; identical to SEQ ID NO: 106242
  derived and/or modified sequence opt2 from neuraminidase__InfluenzaA__ABK40078

SEQ ID NO: 107073 - RNA, 1413 nt, Artificial Sequence; identical to SEQ ID NO: 106571
  derived and/or modified sequence opt2 from neuraminidase__InfluenzaA__ABK40513

SEQ ID NO: 107074 - RNA, 1413 nt, Artificial Sequence; identical to SEQ ID NO: 106571
  derived and/or modified sequence opt2 from neuraminidase__InfluenzaA__ABK40538

SEQ ID NO: 107075 - RNA, 1413 nt, Artificial Sequence
  derived and/or modified sequence opt2 from neuraminidase__InfluenzaA__ABK40549
augaaccccaaccagaagaucaucaccaucggcuccaucugcaugaccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuacaagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgccaacugguccuggcccgacggcgccgagcuccccuucaccaucgacaaguga

SEQ ID NO: 107076 - RNA, 1413 nt, Artificial Sequence; identical to SEQ ID NO: 106571
  derived and/or modified sequence opt2 from neuraminidase__InfluenzaA__ABK40560

SEQ ID NO: 107077 - RNA, 1413 nt, Artificial Sequence; identical to SEQ ID NO: 106571
  derived and/or modified sequence opt2 from neuraminidase__InfluenzaA__ABK40571

SEQ ID NO: 107078 - RNA, 1413 nt, Artificial Sequence; identical to SEQ ID NO: 106571
  derived and/or modified sequence opt2 from neuraminidase__InfluenzaA__ABK40582

SEQ ID NO: 107079 - RNA, 1413 nt, Artificial Sequence
  derived and/or modified sequence opt2 from neuraminidase__InfluenzaA__ABK40593
augaaccccaaccagaagaucaucaccaucggcuccaucugcaugaccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccucccaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuacaagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgccaacugguccuggcccgacggcgccgagcuccccuucaccaucgacaaguga

SEQ ID NO: 107080 - RNA, 1413 nt, Artificial Sequence; identical to SEQ ID NO: 106571
  derived and/or modified sequence opt2 from neuraminidase__InfluenzaA__ABK40604

SEQ ID NO: 107081 - RNA, 1410 nt, Artificial Sequence; identical to SEQ ID NO: 106242
  derived and/or modified sequence opt2 from neuraminidase__InfluenzaA__ABK40615

SEQ ID NO: 107082 - RNA, 1410 nt, Artificial Sequence; identical to SEQ ID NO: 105573
  derived and/or modified sequence opt2 from neuraminidase__InfluenzaA__ABK40626

SEQ ID NO: 107083 - RNA, 1410 nt, Artificial Sequence
  derived and/or modified sequence opt2 from neuraminidase__InfluenzaA__ABK40648
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcauccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgaccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 107084 - RNA, 1410 nt, Artificial Sequence; identical to SEQ ID NO: 106625
  derived and/or modified sequence opt2 from neuraminidase__InfluenzaA__ABK40659

SEQ ID NO: 107085 - RNA, 1410 nt, Artificial Sequence; identical to SEQ ID NO: 106613
  derived and/or modified sequence opt2 from neuraminidase__InfluenzaA__ABK40681

SEQ ID NO: 107086 - RNA, 1413 nt, Artificial Sequence
  derived and/or modified sequence opt2 from neuraminidase__InfluenzaA__ABK40692
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccugggagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107087 - RNA, 1410 nt, Artificial Sequence; identical to SEQ ID NO: 106242
  derived and/or modified sequence opt2 from neuraminidase__InfluenzaA__ABK40703

SEQ ID NO: 107088 - RNA, 1410 nt, Artificial Sequence; identical to SEQ ID NO: 106242
  derived and/or modified sequence opt2 from neuraminidase__InfluenzaA__ABK40714

SEQ ID NO: 107089 - RNA, 1410 nt, Artificial Sequence; identical to SEQ ID NO: 106242
  derived and/or modified sequence opt2 from neuraminidase__InfluenzaA__ABK40725

SEQ ID NO: 107090 - RNA, 1410 nt, Artificial Sequence; identical to SEQ ID NO: 106242
  derived and/or modified sequence opt2 from neuraminidase__InfluenzaA__ABK40736

SEQ ID NO: 107091 - RNA, 1410 nt, Artificial Sequence; identical to SEQ ID NO: 106957
  derived and/or modified sequence opt2 from neuraminidase__InfluenzaA__ABK40747

SEQ ID NO: 107092 - RNA, 1413 nt, Artificial Sequence; identical to SEQ ID NO: 106463
  derived and/or modified sequence opt2 from neuraminidase__InfluenzaA__ABK79951

SEQ ID NO: 107093 - RNA, 1413 nt, Artificial Sequence; identical to SEQ ID NO: 107068
  derived and/or modified sequence opt2 from neuraminidase__InfluenzaA__ABK79973

SEQ ID NO: 107094 - RNA, 1410 nt, Artificial Sequence; identical to SEQ ID NO: 106242
  derived and/or modified sequence opt2 from neuraminidase__InfluenzaA__ABK79984

SEQ ID NO: 107095 - RNA, 1410 nt, Artificial Sequence; identical to SEQ ID NO: 106242
  derived and/or modified sequence opt2 from neuraminidase__InfluenzaA__ABK79995

SEQ ID NO: 107096 - RNA, 1413 nt, Artificial Sequence; identical to SEQ ID NO: 106571
  derived and/or modified sequence opt2 from neuraminidase__InfluenzaA__ABK80028

SEQ ID NO: 107097 - RNA, 1413 nt, Artificial Sequence; identical to SEQ ID NO: 106571
  derived and/or modified sequence opt2 from neuraminidase__InfluenzaA__ABK80039

SEQ ID NO: 107098 - RNA, 1413 nt, Artificial Sequence; identical to SEQ ID NO: 106571
  derived and/or modified sequence opt2 from neuraminidase__InfluenzaA__ABK80050

SEQ ID NO: 107099 - RNA, 1410 nt, Artificial Sequence
  derived and/or modified sequence opt2 from neuraminidase__InfluenzaA__ABK80061
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107100 - RNA, 1410 nt, Artificial Sequence; identical to SEQ ID NO: 105573
  derived and/or modified sequence opt2 from neuraminidase__InfluenzaA__ABK80072

SEQ ID NO: 107101 - RNA, 1410 nt, Artificial Sequence
  derived and/or modified sequence opt2 from neuraminidase__InfluenzaA__ABK80083
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107102 - RNA, 1410 nt, Artificial Sequence
  derived and/or modified sequence opt2 from neuraminidase__InfluenzaA__ABK80094
augaaccccaaccagaagaucaucaccaucggcuccgucucccucaucaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107103 - RNA, 1410 nt, Artificial Sequence; identical to SEQ ID NO: 106242
  derived and/or modified sequence opt2 from neuraminidase__InfluenzaA__ABK80105

SEQ ID NO: 107104 - RNA, 1410 nt, Artificial Sequence
  derived and/or modified sequence opt2 from neuraminidase__InfluenzaA__ABK80138
augaaccccaaccagaagaucaucaccaucggcuccgucucccucaccaucgccaccaucugcuuccucaugcagaccgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107105 - RNA, 1410 nt, Artificial Sequence
  derived and/or modified sequence opt2 from neuraminidase__InfluenzaA__ABK80149
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggccaugcucuacgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107106 - RNA, 1410 nt, Artificial Sequence; identical to SEQ ID NO: 107105
  derived and/or modified sequence opt2 from neuraminidase__InfluenzaA__ABK80160

SEQ ID NO: 107107 - RNA, 1410 nt, Artificial Sequence
  derived and/or modified sequence opt2 from neuraminidase__InfluenzaA__ABK80171
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucuucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107108 - RNA, 1410 nt, Artificial Sequence
  derived and/or modified sequence opt2 from neuraminidase__InfluenzaA__ABK80182
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggcaagcucgucgacuccaucggcuccugguccaagaagauccuccgcacccaggaguccgagugcgucugcaucaacggcaccugcgccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107109 - RNA, 1410 nt, Artificial Sequence
  derived and/or modified sequence opt2 from neuraminidase__InfluenzaA__ABK80193
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucggcgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107110 - RNA, 1410 nt, Artificial Sequence
  derived and/or modified sequence opt2 from neuraminidase__InfluenzaA__ABK80204
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggcaagcucgucgacuccaucggcuccugguccaagaagauccuccgcacccaggaguccgagugcgucugcaucaacggcaccugcgccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgccuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107111 - RNA, 1410 nt, Artificial Sequence; identical to SEQ ID NO: 106103
  derived and/or modified sequence opt2 from neuraminidase__InfluenzaA__ABK80215

SEQ ID NO: 107112 - RNA, 1410 nt, Artificial Sequence; identical to SEQ ID NO: 106103
  derived and/or modified sequence opt2 from neuraminidase__InfluenzaA__ABK80226

SEQ ID NO: 107113 - RNA, 1410 nt, Artificial Sequence
  derived and/or modified sequence opt2 from neuraminidase__InfluenzaA__ABK80237
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaccgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107114 - RNA, 1410 nt, Artificial Sequence
  derived and/or modified sequence opt2 from neuraminidase__InfluenzaA__ABK80259
augaaccccaaccagaagaucaucaccaucggcuccgccucccucaccaucgccaccaucugcuuccucauccagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucuccuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107115 - RNA, 1410 nt, Artificial Sequence; identical to SEQ ID NO: 105839
  derived and/or modified sequence opt2 from neuraminidase__InfluenzaA__ABK80270

SEQ ID NO: 107116 - RNA, 1410 nt, Artificial Sequence; identical to SEQ ID NO: 106226
  derived and/or modified sequence opt2 from neuraminidase__InfluenzaA__ABK80281

SEQ ID NO: 107117 - RNA, 1410 nt, Artificial Sequence
  derived and/or modified sequence opt2 from neuraminidase__InfluenzaA__ABK80292
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcuccaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107118 - RNA, 1410 nt, Artificial Sequence
  derived and/or modified sequence opt2 from neuraminidase__InfluenzaA__ABK80303
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucuacgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcaacgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107119 - RNA, 1410 nt, Artificial Sequence
  derived and/or modified sequence opt2 from neuraminidase__InfluenzaA__ABK80314
augaaccccaaccagaagaucaucaccaucggcuccgucucccucaccaucgccaccaucugcuuccucaugcagaucgccauccucgucaccaccgucacccuccacuucaagcaguacgagugcgacuccccccccaacaaccaggucaugcucuacgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107120 - RNA, 1350 nt, Artificial Sequence
  derived and/or modified sequence opt2 from neuraminidase__InfluenzaA__ABL07021
augaaccccaaccagaagaucaucaccaucggcuccaucugcauggucaucggcaucgucucccucaugcuccagaucggcaacaugaucuccaucugggucucccacuccauccagaagggcaaccagcaccaggccgaguccaucuccaacaccaacccccucaccgagaaggccgucgccuccaucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaugaagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107121 - RNA, 1350 nt, Artificial Sequence
  derived and/or modified sequence opt2 from neuraminidase__InfluenzaA__ABL07032
augaaccccaaccagaagaucaucaccaucggcuccaucugcauggucaucggcaucgucucccucaugcuccagaucggcaacauggucuccaccugggucucccacuccauccagaccggcaaccaguaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107122 - RNA, 1350 nt, Artificial Sequence
  derived and/or modified sequence opt2 from neuraminidase__InfluenzaA__ABL31746
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaacuccuggcucaccaucggcaucuccggccccgacaacgaggccgucgccguccucaaguacaacggcaucaucaccgacaccaucaaguccuggcgcaagaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107123 - RNA, 1350 nt, Artificial Sequence
  derived and/or modified sequence opt2 from neuraminidase__InfluenzaA__ABL31757
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107124 - RNA, 1350 nt, Artificial Sequence; identical to SEQ ID NO: 107123
  derived and/or modified sequence opt2 from neuraminidase__InfluenzaA__ABL31768

SEQ ID NO: 107125 - RNA, 1410 nt, Artificial Sequence; identical to SEQ ID NO: 106103
  derived and/or modified sequence opt2 from neuraminidase__InfluenzaA__ABL67168

SEQ ID NO: 107126 - RNA, 1410 nt, Artificial Sequence; identical to SEQ ID NO: 106242
  derived and/or modified sequence opt2 from neuraminidase__InfluenzaA__ABL67179

SEQ ID NO: 107127 - RNA, 1413 nt, Artificial Sequence; identical to SEQ ID NO: 107068
  derived and/or modified sequence opt2 from neuraminidase__InfluenzaA__ABL67190

SEQ ID NO: 107128 - RNA, 1410 nt, Artificial Sequence
  derived and/or modified sequence opt2 from neuraminidase__InfluenzaA__ABL67201
augaaccccaaccagaagaucaucaccaucuccuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107129 - RNA, 1413 nt, Artificial Sequence; identical to SEQ ID NO: 107068
  derived and/or modified sequence opt2 from neuraminidase__InfluenzaA__ABL67212

SEQ ID NO: 107130 - RNA, 1413 nt, Artificial Sequence; identical to SEQ ID NO: 106571
  derived and/or modified sequence opt2 from neuraminidase__InfluenzaA__ABL67256

SEQ ID NO: 107131 - RNA, 1413 nt, Artificial Sequence; identical to SEQ ID NO: 106571
  derived and/or modified sequence opt2 from neuraminidase__InfluenzaA__ABL67267

SEQ ID NO: 107132 - RNA, 1410 nt, Artificial Sequence; identical to SEQ ID NO: 105573
  derived and/or modified sequence opt2 from neuraminidase__InfluenzaA__ABL67278

SEQ ID NO: 107133 - RNA, 1410 nt, Artificial Sequence
  derived and/or modified sequence opt2 from neuraminidase__InfluenzaA__ABL67289
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucuacgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107134 - RNA, 1410 nt, Artificial Sequence
  derived and/or modified sequence opt2 from neuraminidase__InfluenzaA__ABL67300
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107135 - RNA, 1410 nt, Artificial Sequence; identical to SEQ ID NO: 105692
  derived and/or modified sequence opt2 from neuraminidase__InfluenzaA__ABL67311

SEQ ID NO: 107136 - RNA, 1410 nt, Artificial Sequence
  derived and/or modified sequence opt2 from neuraminidase__InfluenzaA__ABL67322
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107137 - RNA, 1410 nt, Artificial Sequence
  derived and/or modified sequence opt2 from neuraminidase__InfluenzaA__ABL67333
augaaccccaaccagaagaucaucaccaucggcuccgucucccucaccaucgccaccaucugcuuccucaugcagaucgccauccucgucaucaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggcaagcucgucgacuccaucggcuccugguccaagaagauccuccgcacccaggaguccgagugcgucugcaucaacggcaccugcgccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107138 - RNA, 1410 nt, Artificial Sequence; identical to SEQ ID NO: 106103
  derived and/or modified sequence opt2 from neuraminidase__InfluenzaA__ABL67344

SEQ ID NO: 107139 - RNA, 1410 nt, Artificial Sequence
  derived and/or modified sequence opt2 from neuraminidase__InfluenzaA__ABL67355
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgagaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107140 - RNA, 1410 nt, Artificial Sequence
  derived and/or modified sequence opt2 from neuraminidase__InfluenzaA__ABL67366
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacacccgcauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107141 - RNA, 1410 nt, Artificial Sequence
  derived and/or modified sequence opt2 from neuraminidase__InfluenzaA__ABL67377
augaaccccaaccagaagaucaucaccaucggcuccgccucccucaccaucgccaucaucugcuuccucauccagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucuccuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgaccucaaccucaugcccaucuga

SEQ ID NO: 107142 - RNA, 1410 nt, Artificial Sequence; identical to SEQ ID NO: 105839
  derived and/or modified sequence opt2 from neuraminidase__InfluenzaA__ABL67388

SEQ ID NO: 107143 - RNA, 1410 nt, Artificial Sequence; identical to SEQ ID NO: 105839
  derived and/or modified sequence opt2 from neuraminidase__InfluenzaA__ABL67399

SEQ ID NO: 107144 - RNA, 1410 nt, Artificial Sequence; identical to SEQ ID NO: 106224
  derived and/or modified sequence opt2 from neuraminidase__InfluenzaA__ABL67410

SEQ ID NO: 107145 - RNA, 1410 nt, Artificial Sequence
  derived and/or modified sequence opt2 from neuraminidase__InfluenzaA__ABL67421
augaaccccaaccagaagaucaucaccaucggcuccaucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107146 - RNA, 1350 nt, Artificial Sequence
  derived and/or modified sequence opt2 from neuraminidase__InfluenzaA__ABL67772
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucaaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 107147 - RNA, 1350 nt, Artificial Sequence
  derived and/or modified sequence opt2 from neuraminidase__InfluenzaA__ABL67783
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 107148 - RNA, 1350 nt, Artificial Sequence
  derived and/or modified sequence opt2 from neuraminidase__InfluenzaA__ABL67796
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuacaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 107149 - RNA, 1350 nt, Artificial Sequence
  derived and/or modified sequence opt2 from neuraminidase__InfluenzaA__ABL67807
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaaccuccucaccgagaaggccgucgccuccgucaagcucgccggcaacuccucccucugccccaucgacggcugggccgucuacuccaaggacaacuccauccgcaucggcuccaagggcgacgucuucgucguccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcgccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 107150 - RNA, 1350 nt, Artificial Sequence
  derived and/or modified sequence opt2 from neuraminidase__InfluenzaA__ABL67818
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaaccuccucaccgagaaggccgucgccuccgucaagcucgccggcaacuccucccucugccccaucgacggcugggccgucuacuccaaggacaacuccauccgcaucggcuccaagggcgacgucuucgucguccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuacugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcgccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 107151 - RNA, 1350 nt, Artificial Sequence
  derived and/or modified sequence opt2 from neuraminidase__InfluenzaA__ABL67829
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaaccuccucaccgagaaggccgucgccuccgucaagcucgccggcaacuccucccucugccccaucaacggcugggccgucuacuccaaggacaacuccauccgcaucggcuccaagggcgacgucuucgucguccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuucugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcgccggcuccugcggccccgucgccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 107152 - RNA, 1410 nt, Artificial Sequence; identical to SEQ ID NO: 106224
  derived and/or modified sequence opt2 from neuraminidase__InfluenzaA__ABM22018

SEQ ID NO: 107153 - RNA, 1413 nt, Artificial Sequence; identical to SEQ ID NO: 107068
  derived and/or modified sequence opt2 from neuraminidase__InfluenzaA__ABM22029

SEQ ID NO: 107154 - RNA, 1410 nt, Artificial Sequence; identical to SEQ ID NO: 106226
  derived and/or modified sequence opt2 from neuraminidase__InfluenzaA__ABM22040

SEQ ID NO: 107155 - RNA, 1410 nt, Artificial Sequence; identical to SEQ ID NO: 107133
  derived and/or modified sequence opt2 from neuraminidase__InfluenzaA__ABM22062

SEQ ID NO: 107156 - RNA, 1410 nt, Artificial Sequence
  derived and/or modified sequence opt2 from neuraminidase__InfluenzaA__ABM22073
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuucaaccucggcacccgccaggucugcaucgccugguccuccuccuccugccacgacggcaaggccuggcuccacgucugcgucaccggcgacgacgagaacgccaccgccuccuucaucuacaacggcaagcucgucgacuccaucggcuccugguccaagaagauccuccgcacccaggaguccgagugcgucugcaucaacggcaccugcgccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107157 - RNA, 1410 nt, Artificial Sequence; identical to SEQ ID NO: 106103
  derived and/or modified sequence opt2 from neuraminidase__InfluenzaA__ABM22084

SEQ ID NO: 107158 - RNA, 1410 nt, Artificial Sequence
  derived and/or modified sequence opt2 from neuraminidase__InfluenzaA__ABM22095
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggccaugcucugcgagcccaccaucaucgagcgcaacaucaccgagaucguccaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107159 - RNA, 1410 nt, Artificial Sequence; identical to SEQ ID NO: 106103
  derived and/or modified sequence opt2 from neuraminidase__InfluenzaA__ABM22106

SEQ ID NO: 107160 - RNA, 1410 nt, Artificial Sequence; identical to SEQ ID NO: 106103
  derived and/or modified sequence opt2 from neuraminidase__InfluenzaA__ABM22117

SEQ ID NO: 107161 - RNA, 1410 nt, Artificial Sequence; identical to SEQ ID NO: 107114
  derived and/or modified sequence opt2 from neuraminidase__InfluenzaA__ABM22128

SEQ ID NO: 107162 - RNA, 1410 nt, Artificial Sequence
  derived and/or modified sequence opt2 from neuraminidase__InfluenzaA__ABM22139
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccgagaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107163 - RNA, 1410 nt, Artificial Sequence
  derived and/or modified sequence opt2 from neuraminidase__InfluenzaA__ABM22150
augaaccccaaccagaagaucaucaccaucggcuccgucucccucaccaucuccaccaucugcuucuucaugcagaucgccauccucaucaccaccgucacccuccacuucaagcaguacgaguucaacucccuccccaacaaccaggucaugcucugcgagcccaccaucaucgagcgcaacaucaccgagaucgucuaccucaccaacaccaccaucgagaaggagaucugccccgagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107164 - RNA, 1413 nt, Artificial Sequence; identical to SEQ ID NO: 106571
  derived and/or modified sequence opt2 from neuraminidase__InfluenzaA__ABM22161

SEQ ID NO: 107165 - RNA, 1413 nt, Artificial Sequence; identical to SEQ ID NO: 106571
  derived and/or modified sequence opt2 from neuraminidase__InfluenzaA__ABM22172

SEQ ID NO: 107166 - RNA, 1413 nt, Artificial Sequence; identical to SEQ ID NO: 106571
  derived and/or modified sequence opt2 from neuraminidase__InfluenzaA__ABM22183

SEQ ID NO: 107167 - RNA, 1413 nt, Artificial Sequence; identical to SEQ ID NO: 106571
  derived and/or modified sequence opt2 from neuraminidase__InfluenzaA__ABM22194

SEQ ID NO: 107168 - RNA, 1413 nt, Artificial Sequence; identical to SEQ ID NO: 106571
  derived and/or modified sequence opt2 from neuraminidase__InfluenzaA__ABM22205

SEQ ID NO: 107169 - RNA, 1413 nt, Artificial Sequence; identical to SEQ ID NO: 106571
  derived and/or modified sequence opt2 from neuraminidase__InfluenzaA__ABM22216

SEQ ID NO: 107170 - RNA, 1413 nt, Artificial Sequence; identical to SEQ ID NO: 106571
  derived and/or modified sequence opt2 from neuraminidase__InfluenzaA__ABM22227

SEQ ID NO: 107171 - RNA, 1413 nt, Artificial Sequence; identical to SEQ ID NO: 106571
  derived and/or modified sequence opt2 from neuraminidase__InfluenzaA__ABM22238

SEQ ID NO: 107172 - RNA, 1413 nt, Artificial Sequence
  derived and/or modified sequence opt2 from neuraminidase__InfluenzaA__ABM22271
augaaccccaaccagaagaucaucaccaucggcuccaucuccaucgucaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucggcgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107173 - RNA, 1413 nt, Artificial Sequence; identical to SEQ ID NO: 106480
  derived and/or modified sequence opt2 from neuraminidase__InfluenzaA__ABM22282

SEQ ID NO: 107174 - RNA, 1410 nt, Artificial Sequence; identical to SEQ ID NO: 105855
  derived and/or modified sequence opt2 from neuraminidase__InfluenzaA__ABM22304

SEQ ID NO: 107175 - RNA, 1410 nt, Artificial Sequence; identical to SEQ ID NO: 105855
  derived and/or modified sequence opt2 from neuraminidase__InfluenzaA__ABM22315

SEQ ID NO: 107176 - RNA, 1410 nt, Artificial Sequence; identical to SEQ ID NO: 105855
  derived and/or modified sequence opt2 from neuraminidase__InfluenzaA__ABM22326

SEQ ID NO: 107177 - RNA, 1410 nt, Artificial Sequence; identical to SEQ ID NO: 105855
  derived and/or modified sequence opt2 from neuraminidase__InfluenzaA__ABM22337

SEQ ID NO: 107178 - RNA, 1410 nt, Artificial Sequence; identical to SEQ ID NO: 105858
  derived and/or modified sequence opt2 from neuraminidase__InfluenzaA__ABM22348

SEQ ID NO: 107179 - RNA, 1410 nt, Artificial Sequence; identical to SEQ ID NO: 105858
  derived and/or modified sequence opt2 from neuraminidase__InfluenzaA__ABM22359

SEQ ID NO: 107180 - RNA, 1410 nt, Artificial Sequence; identical to SEQ ID NO: 105858
  derived and/or modified sequence opt2 from neuraminidase__InfluenzaA__ABM22370

SEQ ID NO: 107181 - RNA, 1413 nt, Artificial Sequence; identical to SEQ ID NO: 106437
  derived and/or modified sequence opt2 from neuraminidase__InfluenzaA__ABM66867

SEQ ID NO: 107182 - RNA, 1413 nt, Artificial Sequence; identical to SEQ ID NO: 106571
  derived and/or modified sequence opt2 from neuraminidase__InfluenzaA__ABM66900

SEQ ID NO: 107183 - RNA, 1413 nt, Artificial Sequence; identical to SEQ ID NO: 106571
  derived and/or modified sequence opt2 from neuraminidase__InfluenzaA__ABM66911

SEQ ID NO: 107184 - RNA, 1410 nt, Artificial Sequence; identical to SEQ ID NO: 105858
  derived and/or modified sequence opt2 from neuraminidase__InfluenzaA__ABM66922

SEQ ID NO: 107185 - RNA, 1410 nt, Artificial Sequence; identical to SEQ ID NO: 105858
  derived and/or modified sequence opt2 from neuraminidase__InfluenzaA__ABM66933

SEQ ID NO: 107186 - RNA, 1410 nt, Artificial Sequence; identical to SEQ ID NO: 105858
  derived and/or modified sequence opt2 from neuraminidase__InfluenzaA__ABM66944

SEQ ID NO: 107187 - RNA, 1410 nt, Artificial Sequence; identical to SEQ ID NO: 105858
  derived and/or modified sequence opt2 from neuraminidase__InfluenzaA__ABM66955

SEQ ID NO: 107188 - RNA, 1410 nt, Artificial Sequence; identical to SEQ ID NO: 105858
  derived and/or modified sequence opt2 from neuraminidase__InfluenzaA__ABM66966

SEQ ID NO: 107189 - RNA, 1410 nt, Artificial Sequence; identical to SEQ ID NO: 105858
  derived and/or modified sequence opt2 from neuraminidase__InfluenzaA__ABM66977

SEQ ID NO: 107190 - RNA, 1410 nt, Artificial Sequence; identical to SEQ ID NO: 105858
  derived and/or modified sequence opt2 from neuraminidase__InfluenzaA__ABM66988

SEQ ID NO: 107191 - RNA, 1410 nt, Artificial Sequence; identical to SEQ ID NO: 105858
  derived and/or modified sequence opt2 from neuraminidase__InfluenzaA__ABM66999

SEQ ID NO: 107192 - RNA, 1410 nt, Artificial Sequence; identical to SEQ ID NO: 105858
  derived and/or modified sequence opt2 from neuraminidase__InfluenzaA__ABM67010

SEQ ID NO: 107193 - RNA, 1410 nt, Artificial Sequence; identical to SEQ ID NO: 105858
  derived and/or modified sequence opt2 from neuraminidase__InfluenzaA__ABM67021

SEQ ID NO: 107194 - RNA, 1413 nt, Artificial Sequence
  derived and/or modified sequence opt2 from neuraminidase__InfluenzaA__ABM67054
augaaccccaaccagaagaucaucaccaucggcuccaucuccaucgccaucggcaccaucucccucaugcuccagaucggcaacaugaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107195 - RNA, 1350 nt, Artificial Sequence
  derived and/or modified sequence opt2 from neuraminidase__InfluenzaA__ABM68048
augaaccccaaccagaagaucaucaccaucggcuccaucugcauggucaucggcaucgucucccucaugcuccagaucggcaacaucaucuccaucuggaucucccacuccauccagaccggcaaccagugccaggccggccccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgaguccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacuccuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107196 - RNA, 1350 nt, Artificial Sequence
  derived and/or modified sequence opt2 from neuraminidase__InfluenzaA__ABM68049
augaaccccaaccagaagaucaucaccaucggcuccaucugcauggucaucggcaucgucucccucaugcuccagaucggcaacaucaucuccaucuggaucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacuccuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107197 - RNA, 1350 nt, Artificial Sequence
  derived and/or modified sequence opt2 from neuraminidase__InfluenzaA__ABM90436
augaaccccaaccagaagaucaucaccaucggcuccaucugcauggucaucggcaucgucucccucaugcuccagaucggcaacaugaucuccaucugggucucccacuccauccagaagggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaugaagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107198 - RNA, 1350 nt, Artificial Sequence; identical to SEQ ID NO: 107197
  derived and/or modified sequence opt2 from neuraminidase__InfluenzaA__ABM90447

SEQ ID NO: 107199 - RNA, 1350 nt, Artificial Sequence; identical to SEQ ID NO: 107197
  derived and/or modified sequence opt2 from neuraminidase__InfluenzaA__ABM90458

SEQ ID NO: 107200 - RNA, 1350 nt, Artificial Sequence; identical to SEQ ID NO: 107197
  derived and/or modified sequence opt2 from neuraminidase__InfluenzaA__ABM90469

SEQ ID NO: 107201 - RNA, 1350 nt, Artificial Sequence
  derived and/or modified sequence opt2 from neuraminidase__InfluenzaA__ABM90491
augaaccccaaccagaagaucaucaccaucggcuccaucugcauggucaucggcaucgucucccucaugcuccagaucggcaacaugaucuccaucugggucucccacuccauccagaagggcaaccagcaccaggccgaguccaucuccaacaccaacccccucaccgagaaggccgucgccuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaugaagaagggcaaggucaucaaguccgucgagcucgacgccaccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107202 - RNA, 1350 nt, Artificial Sequence; identical to SEQ ID NO: 107201
  derived and/or modified sequence opt2 from neuraminidase__InfluenzaA__ABM90502

SEQ ID NO: 107203 - RNA, 1350 nt, Artificial Sequence
  derived and/or modified sequence opt2 from neuraminidase__InfluenzaA__ABM90524
augaaccccaaccagaagaucaucaccaucggcuccaucugcauggucaucggcaucgucucccucaugcuccagaucggcaacaugaucuccaucugggucucccacuccauccagaccggcaaccagcaccaggccgaguccaucuccaacaccaacccccucaccgagaaggccgucgucuccgucacccucgccggcaacuccucccucugccccauccgcggcugggccguccacuccaaggacaacaacauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107204 - RNA, 1350 nt, Artificial Sequence; identical to SEQ ID NO: 107203
  derived and/or modified sequence opt2 from neuraminidase__InfluenzaA__ABM90535

SEQ ID NO: 107205 - RNA, 1350 nt, Artificial Sequence; identical to SEQ ID NO: 107203
  derived and/or modified sequence opt2 from neuraminidase__InfluenzaA__ABM90546

SEQ ID NO: 107206 - RNA, 1413 nt, Artificial Sequence
  derived and/or modified sequence opt2 from neuraminidase__InfluenzaA__ABN50759
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccaggccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcauccgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107207 - RNA, 1410 nt, Artificial Sequence
  derived and/or modified sequence opt2 from neuraminidase__InfluenzaA__ABN50770
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107208 - RNA, 1413 nt, Artificial Sequence
  derived and/or modified sequence opt2 from neuraminidase__InfluenzaA__ABN50903
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccguccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucauccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107209 - RNA, 1413 nt, Artificial Sequence; identical to SEQ ID NO: 106571
  derived and/or modified sequence opt2 from neuraminidase__InfluenzaA__ABN50920

SEQ ID NO: 107210 - RNA, 1413 nt, Artificial Sequence
  derived and/or modified sequence opt2 from neuraminidase__InfluenzaA__ABN50931
augaaccccaaccagaagaucaucaccaucggcuccaucugcauggccaucggcaucaucucccucauccuccagaucggcaacaucgucuccaucuggaucucccacuccauccagaccggcucccagaacuacaccggcaucugcaaccagcgcaucaucaccuacgagaacuccaccugggucaaccagaccuacgucaacaucaacaacaccaacgucgucgccggccaggacaccaccuccgucgcccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccaacaacggccccgccuccuacaagaucuucaagaucgagaagggcaagaucaccaaguccaucgagcucgacgcccccaacucccacuacgaggagugcuccugcuaccccgacgccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgccgcggcuucgagaugaucugggaccccaacggcuggaccgacaccgacuccaaguuccucgucaagcaggacgucgucgccaucaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 107211 - RNA, 1413 nt, Artificial Sequence
  derived and/or modified sequence opt2 from neuraminidase__InfluenzaA__ABN50943
augaaccccaaccagaagaucaucaccaucggcuccaucugcauggccaucggcaucaucucccucauccuccagaucggcaacaucgucuccaucuggaucucccacuccauccagaccggcucccagaacuacaccggcaucugcaaccagcgcaucaucaccuacgagaacuccaccugggucaaccagaccuacgucaacaucaacaacaccaacgucgucgccggccaggacaccaccuccgucgcccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccaacaacggccccgccuccuacaagaucuucaagaucgagaagggcaagaucaccaaguccaucgagcucgacgcccccaacucccacuacgaggagugcuccugcuaccccgacgccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgccgcggcuucgagaugaucugggaccccaacggcuggaccgacaccgacuccaaguuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 107212 - RNA, 1413 nt, Artificial Sequence; identical to SEQ ID NO: 106480
  derived and/or modified sequence opt2 from neuraminidase__InfluenzaA__ABN50954

SEQ ID NO: 107213 - RNA, 1413 nt, Artificial Sequence; identical to SEQ ID NO: 106480
  derived and/or modified sequence opt2 from neuraminidase__InfluenzaA__ABN50965

SEQ ID NO: 107214 - RNA, 1413 nt, Artificial Sequence; identical to SEQ ID NO: 106480
  derived and/or modified sequence opt2 from neuraminidase__InfluenzaA__ABN50976

SEQ ID NO: 107215 - RNA, 1410 nt, Artificial Sequence; identical to SEQ ID NO: 105855
  derived and/or modified sequence opt2 from neuraminidase__InfluenzaA__ABN50987

SEQ ID NO: 107216 - RNA, 1410 nt, Artificial Sequence; identical to SEQ ID NO: 105858
  derived and/or modified sequence opt2 from neuraminidase__InfluenzaA__ABN50998

SEQ ID NO: 107217 - RNA, 1410 nt, Artificial Sequence
  derived and/or modified sequence opt2 from neuraminidase__InfluenzaA__ABN51013
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccucugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107218 - RNA, 1410 nt, Artificial Sequence
  derived and/or modified sequence opt2 from neuraminidase__InfluenzaA__ABN51024
augaaccccaaccagaagaucaucaccaucggcuccgucucccucaccgucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107219 - RNA, 1410 nt, Artificial Sequence
  derived and/or modified sequence opt2 from neuraminidase__InfluenzaA__ABN51035
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107220 - RNA, 1410 nt, Artificial Sequence; identical to SEQ ID NO: 107219
  derived and/or modified sequence opt2 from neuraminidase__InfluenzaA__ABN51046

SEQ ID NO: 107221 - RNA, 1413 nt, Artificial Sequence
  derived and/or modified sequence opt2 from neuraminidase__InfluenzaA__ABN51069
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagauggucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107222 - RNA, 1413 nt, Artificial Sequence
  derived and/or modified sequence opt2 from neuraminidase__InfluenzaA__ABN51080
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 107223 - RNA, 1413 nt, Artificial Sequence; identical to SEQ ID NO: 105898
  derived and/or modified sequence opt2 from neuraminidase__InfluenzaA__ABN51091

SEQ ID NO: 107224 - RNA, 1410 nt, Artificial Sequence; identical to SEQ ID NO: 105607
  derived and/or modified sequence opt2 from neuraminidase__InfluenzaA__ABN51102

SEQ ID NO: 107225 - RNA, 1410 nt, Artificial Sequence; identical to SEQ ID NO: 105615
  derived and/or modified sequence opt2 from neuraminidase__InfluenzaA__ABN51113

SEQ ID NO: 107226 - RNA, 1410 nt, Artificial Sequence
  derived and/or modified sequence opt2 from neuraminidase__InfluenzaA__ABN51124
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcgucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107227 - RNA, 1410 nt, Artificial Sequence; identical to SEQ ID NO: 105615
  derived and/or modified sequence opt2 from neuraminidase__InfluenzaA__ABN51135

SEQ ID NO: 107228 - RNA, 1413 nt, Artificial Sequence; identical to SEQ ID NO: 105908
  derived and/or modified sequence opt2 from neuraminidase__InfluenzaA__ABN51146

SEQ ID NO: 107229 - RNA, 1410 nt, Artificial Sequence
  derived and/or modified sequence opt2 from neuraminidase__InfluenzaA__ABN51157
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgagaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107230 - RNA, 1410 nt, Artificial Sequence; identical to SEQ ID NO: 107218
  derived and/or modified sequence opt2 from neuraminidase__InfluenzaA__ABN59393

SEQ ID NO: 107231 - RNA, 1365 nt, Artificial Sequence
  derived and/or modified sequence opt2 from neuraminidase__InfluenzaA__ABN59415
augaaccccaaccagaagaucaucaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccugggucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccuccggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccgaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccgccccaaggagaagaccaucuggaccuccgccuccuccaucuccuucugcggcgucaacuccgacaccgucgacugguccuggcccgacggcgccgagcuccccuucuccaucgacaaguga

SEQ ID NO: 107232 - RNA, 1413 nt, Artificial Sequence; identical to SEQ ID NO: 106463
  derived and/or modified sequence opt2 from neuraminidase__InfluenzaA__ABN59426

SEQ ID NO: 107233 - RNA, 1410 nt, Artificial Sequence; identical to SEQ ID NO: 105765
  derived and/or modified sequence opt2 from neuraminidase__InfluenzaA__ABO32659

SEQ ID NO: 107234 - RNA, 1410 nt, Artificial Sequence
  derived and/or modified sequence opt2 from neuraminidase__InfluenzaA__ABO32670
augaaccccaaccagaagaucaucaccaucggcuccgucucccucaccaucuccaccaucugcuucuucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccacaugggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107235 - RNA, 1413 nt, Artificial Sequence; identical to SEQ ID NO: 107086
  derived and/or modified sequence opt2 from neuraminidase__InfluenzaA__ABO32681

SEQ ID NO: 107236 - RNA, 1410 nt, Artificial Sequence
  derived and/or modified sequence opt2 from neuraminidase__InfluenzaA__ABO32695
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugcuccgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107237 - RNA, 1410 nt, Artificial Sequence; identical to SEQ ID NO: 106242
  derived and/or modified sequence opt2 from neuraminidase__InfluenzaA__ABO32754

SEQ ID NO: 107238 - RNA, 1410 nt, Artificial Sequence; identical to SEQ ID NO: 106242
  derived and/or modified sequence opt2 from neuraminidase__InfluenzaA__ABO32765

SEQ ID NO: 107239 - RNA, 1410 nt, Artificial Sequence; identical to SEQ ID NO: 107114
  derived and/or modified sequence opt2 from neuraminidase__InfluenzaA__ABO32778

SEQ ID NO: 107240 - RNA, 1410 nt, Artificial Sequence
  derived and/or modified sequence opt2 from neuraminidase__InfluenzaA__ABO32793
augaaccccaaccagaagaucaucaccaucggcuccgucucccucaccaucuccaccaucugcuucuucaugcagaucgucauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaagaccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107241 - RNA, 1410 nt, Artificial Sequence; identical to SEQ ID NO: 105839
  derived and/or modified sequence opt2 from neuraminidase__InfluenzaA__ABO32806

SEQ ID NO: 107242 - RNA, 1410 nt, Artificial Sequence; identical to SEQ ID NO: 106226
  derived and/or modified sequence opt2 from neuraminidase__InfluenzaA__ABO32819

SEQ ID NO: 107243 - RNA, 1410 nt, Artificial Sequence; identical to SEQ ID NO: 105858
  derived and/or modified sequence opt2 from neuraminidase__InfluenzaA__ABO32830

SEQ ID NO: 107244 - RNA, 1410 nt, Artificial Sequence; identical to SEQ ID NO: 106224
  derived and/or modified sequence opt2 from neuraminidase__InfluenzaA__ABO32841

SEQ ID NO: 107245 - RNA, 1410 nt, Artificial Sequence; identical to SEQ ID NO: 106224
  derived and/or modified sequence opt2 from neuraminidase__InfluenzaA__ABO32852

SEQ ID NO: 107246 - RNA, 1410 nt, Artificial Sequence; identical to SEQ ID NO: 106224
  derived and/or modified sequence opt2 from neuraminidase__InfluenzaA__ABO32863

SEQ ID NO: 107247 - RNA, 1410 nt, Artificial Sequence; identical to SEQ ID NO: 107218
  derived and/or modified sequence opt2 from neuraminidase__InfluenzaA__ABO32874

SEQ ID NO: 107248 - RNA, 1410 nt, Artificial Sequence; identical to SEQ ID NO: 107218
  derived and/or modified sequence opt2 from neuraminidase__InfluenzaA__ABO32885

SEQ ID NO: 107249 - RNA, 1410 nt, Artificial Sequence; identical to SEQ ID NO: 107219
  derived and/or modified sequence opt2 from neuraminidase__InfluenzaA__ABO32896

SEQ ID NO: 107250 - RNA, 1410 nt, Artificial Sequence; identical to SEQ ID NO: 107219
  derived and/or modified sequence opt2 from neuraminidase__InfluenzaA__ABO32907

SEQ ID NO: 107251 - RNA, 1410 nt, Artificial Sequence
  derived and/or modified sequence opt2 from neuraminidase__InfluenzaA__ABO32918
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaccugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaacuccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107252 - RNA, 1410 nt, Artificial Sequence; identical to SEQ ID NO: 107251
  derived and/or modified sequence opt2 from neuraminidase__InfluenzaA__ABO32929

SEQ ID NO: 107253 - RNA, 1410 nt, Artificial Sequence; identical to SEQ ID NO: 107251
  derived and/or modified sequence opt2 from neuraminidase__InfluenzaA__ABO32940

SEQ ID NO: 107254 - RNA, 1413 nt, Artificial Sequence
  derived and/or modified sequence opt2 from neuraminidase__InfluenzaA__ABO32951
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107255 - RNA, 1413 nt, Artificial Sequence
  derived and/or modified sequence opt2 from neuraminidase__InfluenzaA__ABO32962
augaaccccaaccagaagaucaucaccaucggcuccaucuccaucgccaucggcaucaucucccucaugcuccagaucggcaacaucaucuccaucugggccucccacuccauccagaccggcuccaagaaccacaccggcgucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccaacgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucaagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccguccgccaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107256 - RNA, 1413 nt, Artificial Sequence; identical to SEQ ID NO: 105898
  derived and/or modified sequence opt2 from neuraminidase__InfluenzaA__ABO32973

SEQ ID NO: 107257 - RNA, 1413 nt, Artificial Sequence; identical to SEQ ID NO: 106463
  derived and/or modified sequence opt2 from neuraminidase__InfluenzaA__ABO32984

SEQ ID NO: 107258 - RNA, 1413 nt, Artificial Sequence; identical to SEQ ID NO: 106463
  derived and/or modified sequence opt2 from neuraminidase__InfluenzaA__ABO32995

SEQ ID NO: 107259 - RNA, 1413 nt, Artificial Sequence
  derived and/or modified sequence opt2 from neuraminidase__InfluenzaA__ABO33009
augaaccccaaccagaagaucaucaccaucggcuccaucugcauggccaucggcaugaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107260 - RNA, 1410 nt, Artificial Sequence; identical to SEQ ID NO: 107030
  derived and/or modified sequence opt2 from neuraminidase__InfluenzaA__ABO33039

SEQ ID NO: 107261 - RNA, 1410 nt, Artificial Sequence
  derived and/or modified sequence opt2 from neuraminidase__InfluenzaA__ABO33050
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107262 - RNA, 1410 nt, Artificial Sequence; identical to SEQ ID NO: 106242
  derived and/or modified sequence opt2 from neuraminidase__InfluenzaA__ABO33061

SEQ ID NO: 107263 - RNA, 1410 nt, Artificial Sequence
  derived and/or modified sequence opt2 from neuraminidase__InfluenzaA__ABO33072
augaaccccaaccagaagaucaucaccaucggcuccgucucccucaccaucgccaccaucugcuuccucaugcagaucgccauccucgucaccaccgucacccuccacuucaagcaguacgagugcggcucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 107264 - RNA, 1413 nt, Artificial Sequence; identical to SEQ ID NO: 106571
  derived and/or modified sequence opt2 from neuraminidase__InfluenzaA__ABO37991

SEQ ID NO: 107265 - RNA, 1413 nt, Artificial Sequence
  derived and/or modified sequence opt2 from neuraminidase__InfluenzaA__ABO38013
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuacgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107266 - RNA, 1413 nt, Artificial Sequence
  derived and/or modified sequence opt2 from neuraminidase__InfluenzaA__ABO38024
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacaacaccugggucaaccacaccuacgucaacaucaacaacaccaacaucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagauggucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107267 - RNA, 1413 nt, Artificial Sequence
  derived and/or modified sequence opt2 from neuraminidase__InfluenzaA__ABO38035
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaccugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgaggucaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggcaugccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107268 - RNA, 1413 nt, Artificial Sequence; identical to SEQ ID NO: 105908
  derived and/or modified sequence opt2 from neuraminidase__InfluenzaA__ABO38046

SEQ ID NO: 107269 - RNA, 1413 nt, Artificial Sequence; identical to SEQ ID NO: 106463
  derived and/or modified sequence opt2 from neuraminidase__InfluenzaA__ABO38068

SEQ ID NO: 107270 - RNA, 1410 nt, Artificial Sequence; identical to SEQ ID NO: 105839
  derived and/or modified sequence opt2 from neuraminidase__InfluenzaA__ABO38079

SEQ ID NO: 107271 - RNA, 1410 nt, Artificial Sequence
  derived and/or modified sequence opt2 from neuraminidase__InfluenzaA__ABO38090
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107272 - RNA, 1410 nt, Artificial Sequence
  derived and/or modified sequence opt2 from neuraminidase__InfluenzaA__ABO38101
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107273 - RNA, 1410 nt, Artificial Sequence
  derived and/or modified sequence opt2 from neuraminidase__InfluenzaA__ABO38233
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgccuccuccuacgucugcuccggccucgucggcgacaccccccgcaagaacgaccgcuacuccuccuccuacugccgcaaccccaacaacgagaagggcaaccacggcgucaagggcugggccuucgacgacggcaacgacgucuggaugggccgcaccaucuccgacgagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 107274 - RNA, 1410 nt, Artificial Sequence; identical to SEQ ID NO: 106623
  derived and/or modified sequence opt2 from neuraminidase__InfluenzaA__ABO38244

SEQ ID NO: 107275 - RNA, 1410 nt, Artificial Sequence; identical to SEQ ID NO: 105839
  derived and/or modified sequence opt2 from neuraminidase__InfluenzaA__ABO38255

SEQ ID NO: 107276 - RNA, 1410 nt, Artificial Sequence; identical to SEQ ID NO: 106224
  derived and/or modified sequence opt2 from neuraminidase__InfluenzaA__ABO38277

SEQ ID NO: 107277 - RNA, 1410 nt, Artificial Sequence; identical to SEQ ID NO: 107251
  derived and/or modified sequence opt2 from neuraminidase__InfluenzaA__ABO38288

SEQ ID NO: 107278 - RNA, 1410 nt, Artificial Sequence
  derived and/or modified sequence opt2 from neuraminidase__InfluenzaA__ABO38299
augaaccccaaccagaagaucaucaccaucggcuccgucucccucaccaucgccaccgucugcuucaucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggccgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacgucgaggagugcuccugcuacccccgcuaccccgacguccgcugcaccugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107279 - RNA, 1410 nt, Artificial Sequence
  derived and/or modified sequence opt2 from neuraminidase__InfluenzaA__ABO38310
augaaccccaaccagaagaucaucaccaucggcuccgucucccucaccaucgccaccgucugcuuccucaugcagaucgccauccucgccaccaccgucacccuccacuucaagcagcacgagugcgacucccccaccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacggcgacuccuccuccaacuccaacugccgcgaccccaacaacgagcgcggcaaccccggcgucaagggcugggccuucgacaacggcgacgacgucuggaugggccgcaccaucaacaaggagucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107280 - RNA, 1413 nt, Artificial Sequence; identical to SEQ ID NO: 106442
  derived and/or modified sequence opt2 from neuraminidase__InfluenzaA__ABO38332

SEQ ID NO: 107281 - RNA, 1413 nt, Artificial Sequence
  derived and/or modified sequence opt2 from neuraminidase__InfluenzaA__ABO38343
augaaccccaaccagaagaucaucaccaucggcuccaucugcaugaccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucguccgcggccgcccccgcgagggcaccaccgucuggaccuccggcuccuccaucuccuucugcggcgucaacuccgacaccgccaacugguccuggcccgacggcgccgagcuccccuucaccaucgacaaguga

SEQ ID NO: 107282 - RNA, 1410 nt, Artificial Sequence
  derived and/or modified sequence opt2 from neuraminidase__InfluenzaA__ABO38354
augaaccccaaccagaagaucaucaccaucggcuccaucugcauggucgucggcaucaucucccucauccuccagaucggcaacaucaucuccaucuggaucucccacuccauccagaccggcucccagaaccacaccggcaucugcaaccagaacaucaucaccuacaagaacuccaccugggucaaccagaccuacgucaacaucuccaacaccaacgucgucgccggccaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgaccgccacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccaacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaccggcuccugcggccccgucuacgucgacggcgccaacggcgucaagggcuucuccuaccgcuacggcaacggcgucuggaucggccgcaccaaguccaacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 107283 - RNA, 1413 nt, Artificial Sequence
  derived and/or modified sequence opt2 from neuraminidase__InfluenzaA__ABO38365
augaaccccaaccagaagaucaucaccaucggcuccaucugcauggccaucggcaucaucucccucauccuccagaugggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgccaacugguccuggcccgacggcgccgagcuccccuucaccaucgacaaguga

SEQ ID NO: 107284 - RNA, 1410 nt, Artificial Sequence
  derived and/or modified sequence opt2 from neuraminidase__InfluenzaA__ABO38376
augaaccccaaccagaagaucaucaccaucggcuccaucugcauggucgucggcaucaucucccucauccuccagaucggcaacaucaucuccaucuggaucucccacuccauccagaccggcucccagaaccacaccggcaccugcaaccaguccaucaucaccuacaagaacuccaccugggucaaccagaccuacgucaacaucuccaacaccaacgucgucgccggcaaggacaccaccuccgucauccucgccggcaacuccucccucugccccauccgcggcugggccaucuacuccaaggacaacggcguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaaggagauccuccgcacccaggaguccgagugcgccugcgucaacggcuccugcuucaccaucaugaccgacggccccuccggcggccccgccuccuacaagaucuucaagaucgagaagggcaaggucaccaaguccaucgagcucgacgcccccaacucccacuacgaggagugcuccugcuaccccgacaccggcaaggucaugugcgucugccgcgacaacuggcacggcuccaaccgccccugggucuccuucgaccagaaccucgacuaccagaugggcuacaucugcuccggcgucuucggcgacaacccccgccccaaggacggcaagggcaacugcggccccgucuacgucgacggcgccaacggcgucaagggcuucuccuaccgcuacggcaacggcgucuggaucggccgcaccaaguccaacuccucccgccagggcuucgagaugaucugggaccccaacggcuggaccgagaccgacuccaacuucuucgucaagcaggacgucgucgccgucaccgacugguccggcuacuccggcuccuucguccagcaccccgagcucaccggccucgacugcaugcgccccugcuucugggucgagcucauccgcggccgccccaaggagaagaccaucuggaccuccggcuccuccaucuccuucugcggcgucaacuccgacaccgucgacugguccuggcccgacggcgccgagcuccccuucaccaucgacaaguga

SEQ ID NO: 107285 - RNA, 1410 nt, Artificial Sequence
  derived and/or modified sequence opt2 from neuraminidase__InfluenzaA__ABO38387
augaaccccaaccagaagaucaucaccaucggcuccaucugcauggucgucggcaucaucucccucauccuccagaucggcaacaucaucuccaucuggaucucccacuccauccagaccggcucccagaaccacaccggcaucugcaaccaguccaucaucaccuacaagaacuccaccugggucaaccagaccuacgucaacaucuccaacaccaacgucgucgccggccaggacaccaccuccgucauccucaccggcaacuccucccucugccccauccgcggcugggccaucuacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacgaggccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaccggcuccugcggccccgucuacgucgacggcgccaacggcgucaagggcuucuccuaccgcuacggcaacggcgucuggaucggccgcaccaaguccaccuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccagcccaaggagaagaccaucuggaccuccggcuccuccaucuccuucugcggcgucaacuccgacaccgucgacugguccuggcccgacggcgccgagcuccccuucaccaucgacaaguga

SEQ ID NO: 107286 - RNA, 1413 nt, Artificial Sequence
  derived and/or modified sequence opt2 from neuraminidase__InfluenzaA__ABO38398
augaaccccaaccagaagaucaucaccaucggcuccaucugcauggccaucggcaucaucucccucauccuccagaucggcaacaucgucuccaucuggaucucccacuccauccagaccggcucccagaacuacaccggcaucugcaaccagcgcaucaucaccuacgagaacuccaccugggucaaccagaccuacgucaacaucaacaacaccaacgucgucgccggccaggacaccaccuccgucgcccucgccggcaacuccucccucugccccaucuccggcugggccaucuacuccaaggacaacuccauccgcaucggcuccaagggcgacgucuucgucauccgcgagcccuucaucuccugcucccaccucgagugccgcaacuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccaacaacggccccgccuccuacaagaucuucaagaucgagaagggcaagaucaccaaguccaucgagcucgacgcccccaacucccacuacgaggagugcuccugcuaccccgacgccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgccgcggcuucgagaugaucugggaccccaacggcuggaccgacaccgacuccaaguuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 107287 - RNA, 1410 nt, Artificial Sequence; identical to SEQ ID NO: 105765
  derived and/or modified sequence opt2 from neuraminidase__InfluenzaA__ABO38420

SEQ ID NO: 107288 - RNA, 1410 nt, Artificial Sequence
  derived and/or modified sequence opt2 from neuraminidase__InfluenzaA__ABO38715
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaccugccccaaggucgucgaguaccgcuccugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccaucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107289 - RNA, 1410 nt, Artificial Sequence; identical to SEQ ID NO: 107288
  derived and/or modified sequence opt2 from neuraminidase__InfluenzaA__ABO38726

SEQ ID NO: 107290 - RNA, 1413 nt, Artificial Sequence
  derived and/or modified sequence opt2 from neuraminidase__InfluenzaA__ABO44049
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaucugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107291 - RNA, 1410 nt, Artificial Sequence
  derived and/or modified sequence opt2 from neuraminidase__InfluenzaA__ABO44060
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaaccucaugcccaucuga

SEQ ID NO: 107292 - RNA, 1410 nt, Artificial Sequence
  derived and/or modified sequence opt2 from neuraminidase__InfluenzaA__ABO44071
augaaccccaaccagaagaucaucaccaucggcuucgucuuccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugcaagaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107293 - RNA, 1410 nt, Artificial Sequence; identical to SEQ ID NO: 105858
  derived and/or modified sequence opt2 from neuraminidase__InfluenzaA__ABO44082

SEQ ID NO: 107294 - RNA, 1410 nt, Artificial Sequence
  derived and/or modified sequence opt2 from neuraminidase__InfluenzaA__ABO44093
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccguccucgacaucuccauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcucccaggagacccgcgucugguggaccuccaacuccaucgucgucuucugcggcaccuccggcaccuacggcaccggcuccuggcccgacggcgccaacaucaacuucaugcccaucuga

SEQ ID NO: 107295 - RNA, 1410 nt, Artificial Sequence
  derived and/or modified sequence opt2 from neuraminidase__InfluenzaA__ABO44104
augaaccccaaccagaagaucaucaccaucggcuccgccucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagaagggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaaccucaugcccaucuga

SEQ ID NO: 107296 - RNA, 1413 nt, Artificial Sequence
  derived and/or modified sequence opt2 from neuraminidase__InfluenzaA__ABO44126
augaaccccaaccagaagaucaucaccaucggcuccaucugcauggccaucggcaucaucucccucauccuccagaucggcaacaucgucuccaucuggaucucccacuccauccagaccggcucccagaacuacaccggcaucugcaaccagcgcaucaucaccuacgagaacuccaccugggucaaccagaccuacgucaacaucaacaacaccaacgucgucgccggccaggacaccaccuccgucgcccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccaacaacggccccgccuccuacaagaucuucaagaucgagaagggcaagaucaccaaguccaucgagcucaacgcccccaacucccacuacgaggagugcuccugcuaccccgacgccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgccgcggcuucgagaugaucugggaccccaacggcuggaccgacaccgacuccaaguuccucgucaagcaggacgucgucgccaucaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 107297 - RNA, 1413 nt, Artificial Sequence
  derived and/or modified sequence opt2 from neuraminidase__InfluenzaA__ABO52228
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107298 - RNA, 1410 nt, Artificial Sequence
  derived and/or modified sequence opt2 from neuraminidase__InfluenzaA__ABO52239
augaaccccaaccagaagaucaucaccaucggcuccgucucccucaccaucgccaccgucugcuucaucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggccgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107299 - RNA, 1410 nt, Artificial Sequence; identical to SEQ ID NO: 107295
  derived and/or modified sequence opt2 from neuraminidase__InfluenzaA__ABO52250

SEQ ID NO: 107300 - RNA, 1413 nt, Artificial Sequence
  derived and/or modified sequence opt2 from neuraminidase__InfluenzaA__ABO52261
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccgacggcuggaccgacaccgacuccaacuuccucgucaagcaggacgucgucgccaugaccgacugguccggcuacuccggcuccuucguccagcaccccgagcucaccggccucgacugcauccgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107301 - RNA, 1413 nt, Artificial Sequence
  derived and/or modified sequence opt2 from neuraminidase__InfluenzaA__ABO52283
augaaccccaaccagaagaucaucaccaucggcuccaucugcaugaccaucggcaccaucucccucauccuccagaucggcaacaucaucuccaucuggaucucccacuccauccagaccggcucccagaaccacaccggcaucugcaaccagcgcaucaucaccuacgagaacaacaccugggucaaccagaccuacgucaacaucuccaacaccaacgucgucgccggcaaggacaccaccuccaugauccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaucaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaaggucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcgacggcgucuggaucggccgcaccaaguccaacuccucccgcaagggcuucgagaugaucugggaccccaacggcuggaccgacaccgacgacaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacauguga

SEQ ID NO: 107302 - RNA, 1410 nt, Artificial Sequence; identical to SEQ ID NO: 107030
  derived and/or modified sequence opt2 from neuraminidase__InfluenzaA__ABO52294

SEQ ID NO: 107303 - RNA, 1410 nt, Artificial Sequence
  derived and/or modified sequence opt2 from neuraminidase__InfluenzaA__ABO52316
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccagaucaugcccugcgagcccaccaucaucgagcgcaacaucaccgagaucgucuaccucaccaacaucaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccucccgcugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaagaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcgccggcuccuggcccgacggcgccgacaucaaccucaugcccaucuga

SEQ ID NO: 107304 - RNA, 1410 nt, Artificial Sequence; identical to SEQ ID NO: 105626
  derived and/or modified sequence opt2 from neuraminidase__InfluenzaA__ABO52327

SEQ ID NO: 107305 - RNA, 1410 nt, Artificial Sequence
  derived and/or modified sequence opt2 from neuraminidase__InfluenzaA__ABO52338
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 107306 - RNA, 1410 nt, Artificial Sequence
  derived and/or modified sequence opt2 from neuraminidase__InfluenzaA__ABO52349
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacgucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucauccacaucuccccccucuccggcuccgcccagcacgucgaggagugcuccugcuacccccgcuaccccggcguccgcugcaucugccgcgacaacuggaagggcuccaaccgccccgucgucgacaucaacaugcgcgacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccaacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 107307 - RNA, 1410 nt, Artificial Sequence
  derived and/or modified sequence opt2 from neuraminidase__InfluenzaA__ABO52360
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcaacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107308 - RNA, 1410 nt, Artificial Sequence
  derived and/or modified sequence opt2 from neuraminidase__InfluenzaA__ABO52371
augaaccccaaccagaagaucaucaccaucggcuccgucucccucaccaucgccaccgucugcuuccucaugcagaucgccauccucgucaccaccgucacccuccacuuccgccaguacgagugcgacucccccgccaacaaccaggucaugcccugcgagcccaucaucaucgagcgcaacaucaccgagaucgucuaccucaacaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggcaagcucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucgaggacuacuccaucgacuccuccuacgucugcuccggccucgucggcgacaccccccgcaacaacgaccgcuccggcaacuccaacugccgcaaccccaacaacgagcgcggcaaccacggcgucaagggcugggccuucgacgacggcaacgacgucuggaugggccgcaccaucaacaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 107309 - RNA, 1413 nt, Artificial Sequence
  derived and/or modified sequence opt2 from neuraminidase__InfluenzaA__ABO52800
augaaccccaaccagaagaucaucaccaucggcuccaucugcaugaccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccaacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagcgcaccaccaucuggaccuccggcuccuccaucuccuucugcggcgucaacuccgacaccgccaacugguccuggcccgacggcgccgagcuccccuucaccaucgacaaguga

SEQ ID NO: 107310 - RNA, 1413 nt, Artificial Sequence; identical to SEQ ID NO: 106340
  derived and/or modified sequence opt2 from neuraminidase__InfluenzaA__ABP49220

SEQ ID NO: 107311 - RNA, 1413 nt, Artificial Sequence
  derived and/or modified sequence opt2 from neuraminidase__InfluenzaA__ABP49319
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacaacaccugggucaaccagaccuacgucaacaucuccaacaccaacgucgucgccggcaaggacaccaccuccaugauccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaaggucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacggcaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107312 - RNA, 1410 nt, Artificial Sequence
  derived and/or modified sequence opt2 from neuraminidase__InfluenzaA__ABP49330
augaaccccaaccagaagaucaucaccaucggcuccaucugcauggucgucggcaucaucucccucauccuccagaucggcaacaucaucuccaucuggaucucccacuccauccagaccggcucccagaaccacaccggcaucugcaaccaguccaucaucaccuacaagaacuccaccugggucaaccagaccuacgucaacaucuccaacaccaacgucgucgccggcaagggcaccacccccgucauccucgccggcaacuccucccucugccccauccgcggcugggccaucuacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccugcgccugccacgacggcaugggcuggcucaccaucggcaucuccggccccgacgacgaggccgucgccguccucaaguacaacggcaucaucaccgagaccaucaaguccuggcgcaagaagauccuccgcacccaggaguccgagugcgucugcgucaacggcuccugcuucaccaucaugaccgacggccccuccgacggccccgccuccuacaagaucuucaagaucgagaagggcaaggucaccaaguccaucgagcucgacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaagggcuccugcggccccgucuacgucgacggcgccaacggcgucaagggcuucuccuaccgcuacggcaacggcgucuggaucggccgcaucaaguccaacuccucccgccagggcuucgagaugaucugggaccccaacggcuggaccgagaccgacuccuccuucuucgucaagcaggacgucgucgccaugaccgacugguccggcuacuccggcuccuucguccagcaccccgagcucaccggccucgacugcaugcgccccugcuucugggucgagcucauccgcggccgccccaaggagaagaccaucuggaccuccggcuccuccaucuccuucugcggcgucaacuccgacaccgucgacugguccuggcccgacggcgccgagcuccccuucaccaucgacaaguga

SEQ ID NO: 107313 - RNA, 1413 nt, Artificial Sequence
  derived and/or modified sequence opt2 from neuraminidase__InfluenzaA__ABP49352
augaaccccaaccagaagaucaucaccaucggcuccaucugcaugaccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaccaccuccgucgcccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcggccccgucaccgucgacggcgccgacggcgucaagggcuucuccuacaaguacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagcgcaccaccaucuggaccuccggcuccuccaucuccuucugcggcgucgacuccgacaccgccaacugguccuggcccgacggcgccgagcuccccuucaccaucgacaaguga

SEQ ID NO: 107314 - RNA, 1413 nt, Artificial Sequence; identical to SEQ ID NO: 107210
  derived and/or modified sequence opt2 from neuraminidase__InfluenzaA__ABP49363

SEQ ID NO: 107315 - RNA, 1410 nt, Artificial Sequence; identical to SEQ ID NO: 106242
  derived and/or modified sequence opt2 from neuraminidase__InfluenzaA__ABP49374

SEQ ID NO: 107316 - RNA, 1413 nt, Artificial Sequence
  derived and/or modified sequence opt2 from neuraminidase__InfluenzaA__ABP49385
augaaccccaaccagaagaucaucaccaucggcuccaucuccgucgccaucggcaucaucaaccucacccuccagaucggcaacaucaucuccaucugggccucccacuccauccagaccggcucccagaacuacaccggcaucugcaaccagcgcaucaucaccuacgagaaccgcaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 107317 - RNA, 1413 nt, Artificial Sequence; identical to SEQ ID NO: 105898
  derived and/or modified sequence opt2 from neuraminidase__InfluenzaA__ABP49396

SEQ ID NO: 107318 - RNA, 1410 nt, Artificial Sequence
  derived and/or modified sequence opt2 from neuraminidase__InfluenzaA__ABP49407
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucauguccgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaagaucugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107319 - RNA, 1410 nt, Artificial Sequence; identical to SEQ ID NO: 106242
  derived and/or modified sequence opt2 from neuraminidase__InfluenzaA__ABP49418

SEQ ID NO: 107320 - RNA, 1410 nt, Artificial Sequence; identical to SEQ ID NO: 106242
  derived and/or modified sequence opt2 from neuraminidase__InfluenzaA__ABP49429

SEQ ID NO: 107321 - RNA, 1410 nt, Artificial Sequence
  derived and/or modified sequence opt2 from neuraminidase__InfluenzaA__ABP49440
augaaccccaaccagaagaucaucaccaucggcuccgucucccucaccaucgccaccgucugcuuccucauccagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggacucccgcuccggcuacgagaccuucaaggucaucggcggcugguccacccccaacuccaagucccaggccaaccgccaggucaucgucgacaagaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107322 - RNA, 1413 nt, Artificial Sequence; identical to SEQ ID NO: 106463
  derived and/or modified sequence opt2 from neuraminidase__InfluenzaA__ABP49451

SEQ ID NO: 107323 - RNA, 1410 nt, Artificial Sequence
  derived and/or modified sequence opt2 from neuraminidase__InfluenzaA__ABP49462
augaaccccaaccagaagaucaucaccaucggcuccgucucccucaccaucgccaccgucugcuucaucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggccgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107324 - RNA, 1410 nt, Artificial Sequence; identical to SEQ ID NO: 107272
  derived and/or modified sequence opt2 from neuraminidase__InfluenzaA__ABP49473

SEQ ID NO: 107325 - RNA, 1410 nt, Artificial Sequence
  derived and/or modified sequence opt2 from neuraminidase__InfluenzaA__ABP49495
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaccuccccccucuccggcuccgcccagcacgucgaggagugcuccugcuacccccgcuaccccggcguccgcugcaucugccgcgacaacuggcgcggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcacccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 107326 - RNA, 1410 nt, Artificial Sequence; identical to SEQ ID NO: 105615
  derived and/or modified sequence opt2 from neuraminidase__InfluenzaA__ABP49506

SEQ ID NO: 107327 - RNA, 1410 nt, Artificial Sequence; identical to SEQ ID NO: 105607
  derived and/or modified sequence opt2 from neuraminidase__InfluenzaA__ABP49517

SEQ ID NO: 107328 - RNA, 1413 nt, Artificial Sequence
  derived and/or modified sequence opt2 from neuraminidase__InfluenzaA__ABQ01314
augaaccccaaccagaagaucaucaccaucggcuccaucugcauggccaucggcaccaucucccucauccuccagaucggcaacaucaucuccaucugggucucccacuccauccagaccggcucccagaaccacaccggcaucugcaaccagcgcaucaucaccuacgagaacaacaccugggucaaccagaccuacgucaacaucuccaacaccaacgucgucgccggcaaggacaccaccuccaugauccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaucaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaaggucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacggcaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107329 - RNA, 1413 nt, Artificial Sequence
  derived and/or modified sequence opt2 from neuraminidase__InfluenzaA__ABQ01325
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccaggccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107330 - RNA, 1410 nt, Artificial Sequence; identical to SEQ ID NO: 106242
  derived and/or modified sequence opt2 from neuraminidase__InfluenzaA__ABQ01336

SEQ ID NO: 107331 - RNA, 1410 nt, Artificial Sequence; identical to SEQ ID NO: 106242
  derived and/or modified sequence opt2 from neuraminidase__InfluenzaA__ABQ01347

SEQ ID NO: 107332 - RNA, 1410 nt, Artificial Sequence
  derived and/or modified sequence opt2 from neuraminidase__InfluenzaA__ABQ01358
augaaccccaaccagaagaucaucaccaucggcuccgucucccucaccaucgccaccgucugcuuccucaugcagaucgccauccucgccaccaccgucacccuccacuucaagcagcacgagugcaacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgaggacuccaucggcuccuggucccagaacauccuccgcacccaggaguccgagugcgucugcaucaacggcaccugcaccgucgucaugaccgacggcaacgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccguccucgacaucuccauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcucccaggagacccgcgucugguggaccuccaacuccaucgucgucuucugcggcaccuccggcaccuacggcaccggcuccuggcccgacggcgccaacaucaacuucaugcccaucuga

SEQ ID NO: 107333 - RNA, 1410 nt, Artificial Sequence
  derived and/or modified sequence opt2 from neuraminidase__InfluenzaA__ABQ01369
augaaccccaaccagaagaucaucaccaucggcuccgucucccucaccaucgccaccaucugcuucgucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaccuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaagaacgaccgcuccuccuccuccuacugccgcaaccccaacaacgagaagggcacccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 107334 - RNA, 1410 nt, Artificial Sequence
  derived and/or modified sequence opt2 from neuraminidase__InfluenzaA__ABQ44386
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaacgagguccucuggaccuccaacuccaucgucgucuucugcggcaccuccggcaccuacggcaccggcuccuggcccgacggcgccgacaucaaccucaugcccaucuga

SEQ ID NO: 107335 - RNA, 1410 nt, Artificial Sequence; identical to SEQ ID NO: 106226
  derived and/or modified sequence opt2 from neuraminidase__InfluenzaA__ABQ44408

SEQ ID NO: 107336 - RNA, 1413 nt, Artificial Sequence
  derived and/or modified sequence opt2 from neuraminidase__InfluenzaA__ABQ44419
augaaccccaaccagaagaucaucaccaucggcuccaucugcauggccaucggcaucaucucccucauccuccagaucggcaacaucgucuccaucuggaucucccacuccauccagaacggcucccagaacuacaccggcaucugcaaccagcgcaucaucaccuacgagaacuccaccugggucaaccagaccuacgucaacaucaacaacaccaacgucgucgccggccaggacaccaccuccgucgcccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccaacaacggccccgccuccuacaagaucuucaagaucgagaagggcaagaucaccaaguccaucgagcucgacgcccccaacucccacuacgaggagugcuccugcuaccccgacgccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgccgcggcuucgagaugaucugggaccccaacggcuggaccgacaccgacuccaaguuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 107337 - RNA, 1410 nt, Artificial Sequence; identical to SEQ ID NO: 105858
  derived and/or modified sequence opt2 from neuraminidase__InfluenzaA__ABQ44430

SEQ ID NO: 107338 - RNA, 1410 nt, Artificial Sequence; identical to SEQ ID NO: 107288
  derived and/or modified sequence opt2 from neuraminidase__InfluenzaA__ABQ44441

SEQ ID NO: 107339 - RNA, 1410 nt, Artificial Sequence; identical to SEQ ID NO: 107272
  derived and/or modified sequence opt2 from neuraminidase__InfluenzaA__ABQ44463

SEQ ID NO: 107340 - RNA, 1413 nt, Artificial Sequence
  derived and/or modified sequence opt2 from neuraminidase__InfluenzaA__ABQ44474
augaaccccaaccagaagaucaucaccaucggcuccaucugcaugaccaucggcaccaucucccucauccuccagaucggcaacaucaucuccaucugggucucccacuccauccagaccggcucccagaaccacaccggcaucugcaaccagcgcaucaucaccuacgagaacaacaccugggucaaccagaccuacgucaacaucuccaacaccaacgucgucgccggcaaggacaccaccuccaugauccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaucaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaaggucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacggcaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107341 - RNA, 1410 nt, Artificial Sequence; identical to SEQ ID NO: 105607
  derived and/or modified sequence opt2 from neuraminidase__InfluenzaA__ABR15800

SEQ ID NO: 107342 - RNA, 1413 nt, Artificial Sequence; identical to SEQ ID NO: 107328
  derived and/or modified sequence opt2 from neuraminidase__InfluenzaA__ABR15811

SEQ ID NO: 107343 - RNA, 1413 nt, Artificial Sequence; identical to SEQ ID NO: 106340
  derived and/or modified sequence opt2 from neuraminidase__InfluenzaA__ABR15910

SEQ ID NO: 107344 - RNA, 1410 nt, Artificial Sequence; identical to SEQ ID NO: 105666
  derived and/or modified sequence opt2 from neuraminidase__InfluenzaA__ABR15932

SEQ ID NO: 107345 - RNA, 1410 nt, Artificial Sequence
  derived and/or modified sequence opt2 from neuraminidase__InfluenzaA__ABR15943
augaaccccaaccagaagaucaucaccaucggcuccgucucccucaccaucgccaccaucugcuuccucaugcagaucgccauccucgucaccaccgucacccuccacuuccgccaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107346 - RNA, 1410 nt, Artificial Sequence
  derived and/or modified sequence opt2 from neuraminidase__InfluenzaA__ABR15954
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacaacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107347 - RNA, 1410 nt, Artificial Sequence; identical to SEQ ID NO: 105666
  derived and/or modified sequence opt2 from neuraminidase__InfluenzaA__ABR15965

SEQ ID NO: 107348 - RNA, 1410 nt, Artificial Sequence
  derived and/or modified sequence opt2 from neuraminidase__InfluenzaA__ABR22243
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgaccucaaccucaugcccaucuga

SEQ ID NO: 107349 - RNA, 1410 nt, Artificial Sequence; identical to SEQ ID NO: 106242
  derived and/or modified sequence opt2 from neuraminidase__InfluenzaA__ABR28518

SEQ ID NO: 107350 - RNA, 1410 nt, Artificial Sequence; identical to SEQ ID NO: 106088
  derived and/or modified sequence opt2 from neuraminidase__InfluenzaA__ABR28595

SEQ ID NO: 107351 - RNA, 1413 nt, Artificial Sequence
  derived and/or modified sequence opt2 from neuraminidase__InfluenzaA__ABR28771
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaagucccgcgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107352 - RNA, 1413 nt, Artificial Sequence
  derived and/or modified sequence opt2 from neuraminidase__InfluenzaA__ABR28782
augaaccccaaccagaagaucaucaccaucggcuccaucuccaucgccaucggcauccucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107353 - RNA, 1410 nt, Artificial Sequence; identical to SEQ ID NO: 106356
  derived and/or modified sequence opt2 from neuraminidase__InfluenzaA__ABR28793

SEQ ID NO: 107354 - RNA, 1413 nt, Artificial Sequence; identical to SEQ ID NO: 106340
  derived and/or modified sequence opt2 from neuraminidase__InfluenzaA__ABR28804

SEQ ID NO: 107355 - RNA, 1410 nt, Artificial Sequence; identical to SEQ ID NO: 106242
  derived and/or modified sequence opt2 from neuraminidase__InfluenzaA__ABR28815

SEQ ID NO: 107356 - RNA, 1410 nt, Artificial Sequence; identical to SEQ ID NO: 105666
  derived and/or modified sequence opt2 from neuraminidase__InfluenzaA__ABR28826

SEQ ID NO: 107357 - RNA, 1413 nt, Artificial Sequence; identical to SEQ ID NO: 105908
  derived and/or modified sequence opt2 from neuraminidase__InfluenzaA__ABR28837

SEQ ID NO: 107358 - RNA, 1413 nt, Artificial Sequence
  derived and/or modified sequence opt2 from neuraminidase__InfluenzaA__ABR28848
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgucggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaagaucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagauggucugggaccccaacggcuggaccgacaccgacuccgacuucuccgucaagcaggacgucgucgccaucaccgacugguccggcuacuccggcuccuucguccagcaccccgagcucaccggccucaacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 107359 - RNA, 1410 nt, Artificial Sequence
  derived and/or modified sequence opt2 from neuraminidase__InfluenzaA__ABR28859
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacggccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107360 - RNA, 1410 nt, Artificial Sequence
  derived and/or modified sequence opt2 from neuraminidase__InfluenzaA__ABR28870
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaccgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107361 - RNA, 1410 nt, Artificial Sequence
  derived and/or modified sequence opt2 from neuraminidase__InfluenzaA__ABR28881
augaaccccaaccagaagaucaucaccaucggcuccgucucccucaccaucgccaccgucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107362 - RNA, 1410 nt, Artificial Sequence; identical to SEQ ID NO: 106226
  derived and/or modified sequence opt2 from neuraminidase__InfluenzaA__ABR28892

SEQ ID NO: 107363 - RNA, 1413 nt, Artificial Sequence; identical to SEQ ID NO: 105898
  derived and/or modified sequence opt2 from neuraminidase__InfluenzaA__ABR28903

SEQ ID NO: 107364 - RNA, 1410 nt, Artificial Sequence
  derived and/or modified sequence opt2 from neuraminidase__InfluenzaA__ABR28925
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagguccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107365 - RNA, 1410 nt, Artificial Sequence
  derived and/or modified sequence opt2 from neuraminidase__InfluenzaA__ABR88082
auggaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaucaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107366 - RNA, 1413 nt, Artificial Sequence
  derived and/or modified sequence opt2 from neuraminidase__InfluenzaA__ABS00324
augaaccccaaccagaagaucaucaccaucggcuccaucugcauggccaucggcaucaucucccucauccuccagaucggcaacaucgucuccaucuggaucucccacuccauccagaccggcucccagaacuacaccggcaucugcaaccagcgcaucaucaccuacgagaacuccaccugggucaaccagaccuacgucaacaucaacaacaccaacgucgucgccggccaggacaccaccuccgucgcccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccaacaacggccccgccuccuacaagaucuucaagaucgagaagggcaagaucaccaaguccaucgagcucgacgcccccaacucccacuacgaggagugcuccugcuaccccgacgccggcaccgucaugugcgucugccgcgacaacuggcgcggcuccaaccgccccugggucuccuucaaccagucccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaacuccucccgccgcggcuucgagaugaucugggaccccaacggcuggaccgacaccgacuccaaguuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacggcgacaccgccaacugguccuggcccgacggcuccgagcuccccuucaccaucgacaaguga

SEQ ID NO: 107367 - RNA, 1410 nt, Artificial Sequence; identical to SEQ ID NO: 105626
  derived and/or modified sequence opt2 from neuraminidase__InfluenzaA__ABS49902

SEQ ID NO: 107368 - RNA, 1410 nt, Artificial Sequence
  derived and/or modified sequence opt2 from neuraminidase__InfluenzaA__ABS49913
augaaccccaaccagaagaucaucaccaucggcuccgucucccucaccaucgccaccgucugcuuccucaugcagaucgccauccucgucaccaccgucacccuccacuuccgccaguacgagugcgacucccccaccaacaaccaggucaugcccugcgagcccaucaucaucgagcgcaacaucaccgagaucgucuaccucaacaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucgaggacuacuccaucgacuccuccuacgucugcuccggccucgucggcgacaccccccgcaacaacgaccgcuccuccaacuccaacugccgcaaccccaacaacgagcgcggcaaccacggcgucaagggcugggccuucgacgacggcaacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 107369 - RNA, 1410 nt, Artificial Sequence; identical to SEQ ID NO: 106356
  derived and/or modified sequence opt2 from neuraminidase__InfluenzaA__ABS49968

SEQ ID NO: 107370 - RNA, 1413 nt, Artificial Sequence; identical to SEQ ID NO: 107352
  derived and/or modified sequence opt2 from neuraminidase__InfluenzaA__ABS49979

SEQ ID NO: 107371 - RNA, 1413 nt, Artificial Sequence
  derived and/or modified sequence opt2 from neuraminidase__InfluenzaA__ABS49990
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucauccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107372 - RNA, 1410 nt, Artificial Sequence; identical to SEQ ID NO: 106242
  derived and/or modified sequence opt2 from neuraminidase__InfluenzaA__ABS50001

SEQ ID NO: 107373 - RNA, 1410 nt, Artificial Sequence; identical to SEQ ID NO: 106242
  derived and/or modified sequence opt2 from neuraminidase__InfluenzaA__ABS50012

SEQ ID NO: 107374 - RNA, 1410 nt, Artificial Sequence
  derived and/or modified sequence opt2 from neuraminidase__InfluenzaA__ABS50023
augaaccccaaccagaagaucaucaccaucggcuccgucucccucaccaucgccaccaucugcuuccucaugcagaucgccguccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaucguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107375 - RNA, 1410 nt, Artificial Sequence; identical to SEQ ID NO: 106242
  derived and/or modified sequence opt2 from neuraminidase__InfluenzaA__ABS50034

SEQ ID NO: 107376 - RNA, 1410 nt, Artificial Sequence
  derived and/or modified sequence opt2 from neuraminidase__InfluenzaA__ABS50045
augaaccccaaccagaagaucaucaccaucggcuccgucucccucaccaucgccaccaucugcuuccucaugcagaccgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107377 - RNA, 1410 nt, Artificial Sequence; identical to SEQ ID NO: 105666
  derived and/or modified sequence opt2 from neuraminidase__InfluenzaA__ABS50056

SEQ ID NO: 107378 - RNA, 1410 nt, Artificial Sequence; identical to SEQ ID NO: 105692
  derived and/or modified sequence opt2 from neuraminidase__InfluenzaA__ABS50067

SEQ ID NO: 107379 - RNA, 1410 nt, Artificial Sequence; identical to SEQ ID NO: 106226
  derived and/or modified sequence opt2 from neuraminidase__InfluenzaA__ABS50078

SEQ ID NO: 107380 - RNA, 1413 nt, Artificial Sequence
  derived and/or modified sequence opt2 from neuraminidase__InfluenzaA__ABS71644
augaagcccaaccagaagaucaucaccaucggcuccaucuccaucgccaucggcaucaucucccucauccuccagaucggcaacaucaucuccaucugggccucccacuccauccagaccgagucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaugggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 107381 - RNA, 1413 nt, Artificial Sequence
  derived and/or modified sequence opt2 from neuraminidase__InfluenzaA__ABS71646
augaaccccaaccagaagaucaucaccaucggcuccaucuccaucgccaucggcaucaucucccucauccuccagaucggcaacaucaucuccaucugggccucccacuccauccagaccgagucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaugggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 107382 - RNA, 1413 nt, Artificial Sequence
  derived and/or modified sequence opt2 from neuraminidase__InfluenzaA__ABS71647
augaaccccaaccagaagaucaucaccaucggcuccaucuccaucgccaucggcaucaucucccucauccuccagaucggcaacaucaucuccaucugggccucccacuccauccagaccgagucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaugggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcgccgccaacugguccuggcccgacggcgccgagcuccccuucaccaucgacaaguga

SEQ ID NO: 107383 - RNA, 1413 nt, Artificial Sequence
  derived and/or modified sequence opt2 from neuraminidase__InfluenzaA__ABS71648
augaaccccaaccagaagaucaucaccaucggcuccaucuccaucgccaucggcaucaucucccucauccuccagaucggcaacaucaucuccaucugggccucccacuccauccagaccggcaaccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccggcaccgccaacugguccuggcccgacggcgccgagcuccccuucaccaucgacaaguga

SEQ ID NO: 107384 - RNA, 1413 nt, Artificial Sequence
  derived and/or modified sequence opt2 from neuraminidase__InfluenzaA__ABS71649
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaaccgcgccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107385 - RNA, 1413 nt, Artificial Sequence
  derived and/or modified sequence opt2 from neuraminidase__InfluenzaA__ABS71651
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacaacaccugggucaaccacaccuacgucaacaucaacaacaccaacgucgucgccggcaaggacaagaccuccgucacccucgccggcaacuccucccucugcuccgucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccuccuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggcucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccaacaccgccaacugguccuggcccgacggcgccgagcuccccuucaccaucgacaaguga

SEQ ID NO: 107386 - RNA, 1413 nt, Artificial Sequence
  derived and/or modified sequence opt2 from neuraminidase__InfluenzaA__ABS71652
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacaacaccugggucaaccacaccuacgucaacaucaacaacaccaacgucgucgccggcaaggacaagaccuccgucacccucgccggcaacuccucccucugcuccgucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccuccuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccaacaccgccaacugguccuggcccgacggcgccgagcuccccuucaccaucgacaaguga

SEQ ID NO: 107387 - RNA, 1413 nt, Artificial Sequence
  derived and/or modified sequence opt2 from neuraminidase__InfluenzaA__ABS71653
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucaugaucugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaagucccgcgagcucaacgcccccaacuuccacuacgaggagugcuccugcuaccccgacaucggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgccgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107388 - RNA, 1410 nt, Artificial Sequence
  derived and/or modified sequence opt2 from neuraminidase__InfluenzaA__ABS71655
augaaccccaucaagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107389 - RNA, 1410 nt, Artificial Sequence
  derived and/or modified sequence opt2 from neuraminidase__InfluenzaA__ABS71657
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgccuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107390 - RNA, 1410 nt, Artificial Sequence
  derived and/or modified sequence opt2 from neuraminidase__InfluenzaA__ABS71659
augaaccccaucaagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucggcgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccacaugcccaucuga

SEQ ID NO: 107391 - RNA, 1410 nt, Artificial Sequence
  derived and/or modified sequence opt2 from neuraminidase__InfluenzaA__ABS71660
augaaccccaucaagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107392 - RNA, 1410 nt, Artificial Sequence
  derived and/or modified sequence opt2 from neuraminidase__InfluenzaA__ABS71661
auguaccccaucaagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107393 - RNA, 1410 nt, Artificial Sequence
  derived and/or modified sequence opt2 from neuraminidase__InfluenzaA__ABS71662
augaaccccaucaagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107394 - RNA, 1410 nt, Artificial Sequence
  derived and/or modified sequence opt2 from neuraminidase__InfluenzaA__ABS71663
auguaccccaucaagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgaccagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaugaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107395 - RNA, 1410 nt, Artificial Sequence
  derived and/or modified sequence opt2 from neuraminidase__InfluenzaA__ABU40956
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaacugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucaucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107396 - RNA, 1410 nt, Artificial Sequence
  derived and/or modified sequence opt2 from neuraminidase__InfluenzaA__ABU50651
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107397 - RNA, 1410 nt, Artificial Sequence
  derived and/or modified sequence opt2 from neuraminidase__InfluenzaA__ABU80180
augaaccccaaccagaagaucaucaccaucggcuccgucucccucaccaucgccaccaucugcuuccucaugcagaucgccauccucgucaccaccgucacccuccacuucaagcaguacgagugcaacuccuuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107398 - RNA, 1413 nt, Artificial Sequence; identical to SEQ ID NO: 106340
  derived and/or modified sequence opt2 from neuraminidase__InfluenzaA__ABU80301

SEQ ID NO: 107399 - RNA, 1413 nt, Artificial Sequence
  derived and/or modified sequence opt2 from neuraminidase__InfluenzaA__ABU80312
augaacaccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucaugcgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107400 - RNA, 1410 nt, Artificial Sequence; identical to SEQ ID NO: 106242
  derived and/or modified sequence opt2 from neuraminidase__InfluenzaA__ABU80323

SEQ ID NO: 107401 - RNA, 1410 nt, Artificial Sequence
  derived and/or modified sequence opt2 from neuraminidase__InfluenzaA__ABU80334
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagacccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107402 - RNA, 1410 nt, Artificial Sequence; identical to SEQ ID NO: 105666
  derived and/or modified sequence opt2 from neuraminidase__InfluenzaA__ABU92762

SEQ ID NO: 107403 - RNA, 1410 nt, Artificial Sequence
  derived and/or modified sequence opt2 from neuraminidase__InfluenzaA__ABU92764
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucauggagcgcaacaucaccgagaucgucuaccucaccaacaccaccaucgagaaggagaucugccccaagcucgccgaguaccgcaacugguccaagccccagugcaacgucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggcaagaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107404 - RNA, 1410 nt, Artificial Sequence; identical to SEQ ID NO: 105666
  derived and/or modified sequence opt2 from neuraminidase__InfluenzaA__ABU92765

SEQ ID NO: 107405 - RNA, 1410 nt, Artificial Sequence; identical to SEQ ID NO: 105666
  derived and/or modified sequence opt2 from neuraminidase__InfluenzaA__ABU92766

SEQ ID NO: 107406 - RNA, 1410 nt, Artificial Sequence; identical to SEQ ID NO: 105666
  derived and/or modified sequence opt2 from neuraminidase__InfluenzaA__ABU92767

SEQ ID NO: 107407 - RNA, 1410 nt, Artificial Sequence; identical to SEQ ID NO: 105666
  derived and/or modified sequence opt2 from neuraminidase__InfluenzaA__ABU92768

SEQ ID NO: 107408 - RNA, 1410 nt, Artificial Sequence; identical to SEQ ID NO: 105573
  derived and/or modified sequence opt2 from neuraminidase__InfluenzaA__ABU92769

SEQ ID NO: 107409 - RNA, 1410 nt, Artificial Sequence; identical to SEQ ID NO: 105765
  derived and/or modified sequence opt2 from neuraminidase__InfluenzaA__ABU92770

SEQ ID NO: 107410 - RNA, 1410 nt, Artificial Sequence
  derived and/or modified sequence opt2 from neuraminidase__InfluenzaA__ABU92771
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107411 - RNA, 1410 nt, Artificial Sequence
  derived and/or modified sequence opt2 from neuraminidase__InfluenzaA__ABU92772
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107412 - RNA, 1410 nt, Artificial Sequence
  derived and/or modified sequence opt2 from neuraminidase__InfluenzaA__ABU92773
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaccgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107413 - RNA, 1410 nt, Artificial Sequence
  derived and/or modified sequence opt2 from neuraminidase__InfluenzaA__ABU92774
augaaccccaaccgcaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaccgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107414 - RNA, 1410 nt, Artificial Sequence
  derived and/or modified sequence opt2 from neuraminidase__InfluenzaA__ABU92775
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107415 - RNA, 1410 nt, Artificial Sequence; identical to SEQ ID NO: 105839
  derived and/or modified sequence opt2 from neuraminidase__InfluenzaA__ABU92777

SEQ ID NO: 107416 - RNA, 1410 nt, Artificial Sequence
  derived and/or modified sequence opt2 from neuraminidase__InfluenzaA__ABU92778
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107417 - RNA, 1410 nt, Artificial Sequence; identical to SEQ ID NO: 105737
  derived and/or modified sequence opt2 from neuraminidase__InfluenzaA__ABU92779

SEQ ID NO: 107418 - RNA, 1410 nt, Artificial Sequence; identical to SEQ ID NO: 105737
  derived and/or modified sequence opt2 from neuraminidase__InfluenzaA__ABU92780

SEQ ID NO: 107419 - RNA, 1410 nt, Artificial Sequence; identical to SEQ ID NO: 105737
  derived and/or modified sequence opt2 from neuraminidase__InfluenzaA__ABU92781

SEQ ID NO: 107420 - RNA, 1410 nt, Artificial Sequence
  derived and/or modified sequence opt2 from neuraminidase__InfluenzaA__ABU92782
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgccgcgaggagaccgaggucugguggaccuccaacuccaucgucgucuucugcggcaccuccggcaccuacggcaccggcuccuggcccgacggcgccgacaucaaccucaugcccaucuga

SEQ ID NO: 107421 - RNA, 1410 nt, Artificial Sequence; identical to SEQ ID NO: 105737
  derived and/or modified sequence opt2 from neuraminidase__InfluenzaA__ABU92783

SEQ ID NO: 107422 - RNA, 1410 nt, Artificial Sequence; identical to SEQ ID NO: 105737
  derived and/or modified sequence opt2 from neuraminidase__InfluenzaA__ABU92784

SEQ ID NO: 107423 - RNA, 1410 nt, Artificial Sequence; identical to SEQ ID NO: 105737
  derived and/or modified sequence opt2 from neuraminidase__InfluenzaA__ABU92785

SEQ ID NO: 107424 - RNA, 1410 nt, Artificial Sequence; identical to SEQ ID NO: 105737
  derived and/or modified sequence opt2 from neuraminidase__InfluenzaA__ABU92786

SEQ ID NO: 107425 - RNA, 1410 nt, Artificial Sequence
  derived and/or modified sequence opt2 from neuraminidase__InfluenzaA__ABU92787
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgccaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107426 - RNA, 1410 nt, Artificial Sequence
  derived and/or modified sequence opt2 from neuraminidase__InfluenzaA__ABU92789
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcuccaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107427 - RNA, 1410 nt, Artificial Sequence; identical to SEQ ID NO: 105839
  derived and/or modified sequence opt2 from neuraminidase__InfluenzaA__ABU92790

SEQ ID NO: 107428 - RNA, 1410 nt, Artificial Sequence
  derived and/or modified sequence opt2 from neuraminidase__InfluenzaA__ABU92791
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaccgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107429 - RNA, 1410 nt, Artificial Sequence
  derived and/or modified sequence opt2 from neuraminidase__InfluenzaA__ABU92792
augaaccccaaccagaagaucaucaccaucggcuccgucucccucaccaucuccaccaucugcuucuucaugcagaucgccauccucaucaccaccgucacccuccacuucaagcaguacgucuucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107430 - RNA, 1410 nt, Artificial Sequence; identical to SEQ ID NO: 106319
  derived and/or modified sequence opt2 from neuraminidase__InfluenzaA__ABU92793

SEQ ID NO: 107431 - RNA, 1410 nt, Artificial Sequence; identical to SEQ ID NO: 107426
  derived and/or modified sequence opt2 from neuraminidase__InfluenzaA__ABU92794

SEQ ID NO: 107432 - RNA, 1410 nt, Artificial Sequence; identical to SEQ ID NO: 105737
  derived and/or modified sequence opt2 from neuraminidase__InfluenzaA__ABU92795

SEQ ID NO: 107433 - RNA, 1410 nt, Artificial Sequence; identical to SEQ ID NO: 105737
  derived and/or modified sequence opt2 from neuraminidase__InfluenzaA__ABU92796

SEQ ID NO: 107434 - RNA, 1410 nt, Artificial Sequence
  derived and/or modified sequence opt2 from neuraminidase__InfluenzaA__ABU92797
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagcgcauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucaacgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107435 - RNA, 1410 nt, Artificial Sequence; identical to SEQ ID NO: 105737
  derived and/or modified sequence opt2 from neuraminidase__InfluenzaA__ABU92798

SEQ ID NO: 107436 - RNA, 1410 nt, Artificial Sequence; identical to SEQ ID NO: 105737
  derived and/or modified sequence opt2 from neuraminidase__InfluenzaA__ABU92799

SEQ ID NO: 107437 - RNA, 1410 nt, Artificial Sequence; identical to SEQ ID NO: 105737
  derived and/or modified sequence opt2 from neuraminidase__InfluenzaA__ABU92800

SEQ ID NO: 107438 - RNA, 1410 nt, Artificial Sequence
  derived and/or modified sequence opt2 from neuraminidase__InfluenzaA__ABU92801
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucguccaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107439 - RNA, 1410 nt, Artificial Sequence; identical to SEQ ID NO: 105737
  derived and/or modified sequence opt2 from neuraminidase__InfluenzaA__ABU92802

SEQ ID NO: 107440 - RNA, 1410 nt, Artificial Sequence; identical to SEQ ID NO: 105737
  derived and/or modified sequence opt2 from neuraminidase__InfluenzaA__ABU92804

SEQ ID NO: 107441 - RNA, 1410 nt, Artificial Sequence
  derived and/or modified sequence opt2 from neuraminidase__InfluenzaA__ABU92805
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107442 - RNA, 1410 nt, Artificial Sequence; identical to SEQ ID NO: 107441
  derived and/or modified sequence opt2 from neuraminidase__InfluenzaA__ABU92806

SEQ ID NO: 107443 - RNA, 1410 nt, Artificial Sequence
  derived and/or modified sequence opt2 from neuraminidase__InfluenzaA__ABU92808
augaaccccaaccagaagaucaucaccaucggcuccgucucccucaccaucgccaccaucugcuuccucaugcagaucaccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107444 - RNA, 1410 nt, Artificial Sequence
  derived and/or modified sequence opt2 from neuraminidase__InfluenzaA__ABU92809
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 107445 - RNA, 1410 nt, Artificial Sequence
  derived and/or modified sequence opt2 from neuraminidase__InfluenzaA__ABU92810
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagggcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107446 - RNA, 1410 nt, Artificial Sequence
  derived and/or modified sequence opt2 from neuraminidase__InfluenzaA__ABU92811
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaugaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccgucggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107447 - RNA, 1410 nt, Artificial Sequence; identical to SEQ ID NO: 105737
  derived and/or modified sequence opt2 from neuraminidase__InfluenzaA__ABU92814

SEQ ID NO: 107448 - RNA, 1410 nt, Artificial Sequence; identical to SEQ ID NO: 106226
  derived and/or modified sequence opt2 from neuraminidase__InfluenzaA__ABU92815

SEQ ID NO: 107449 - RNA, 1410 nt, Artificial Sequence; identical to SEQ ID NO: 105737
  derived and/or modified sequence opt2 from neuraminidase__InfluenzaA__ABU92816

SEQ ID NO: 107450 - RNA, 1410 nt, Artificial Sequence
  derived and/or modified sequence opt2 from neuraminidase__InfluenzaA__ABU92817
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgaguccaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107451 - RNA, 1410 nt, Artificial Sequence; identical to SEQ ID NO: 105737
  derived and/or modified sequence opt2 from neuraminidase__InfluenzaA__ABU92818

SEQ ID NO: 107452 - RNA, 1410 nt, Artificial Sequence; identical to SEQ ID NO: 105737
  derived and/or modified sequence opt2 from neuraminidase__InfluenzaA__ABU92819

SEQ ID NO: 107453 - RNA, 1410 nt, Artificial Sequence; identical to SEQ ID NO: 105737
  derived and/or modified sequence opt2 from neuraminidase__InfluenzaA__ABU92821

SEQ ID NO: 107454 - RNA, 1410 nt, Artificial Sequence; identical to SEQ ID NO: 105737
  derived and/or modified sequence opt2 from neuraminidase__InfluenzaA__ABU92822

SEQ ID NO: 107455 - RNA, 1410 nt, Artificial Sequence; identical to SEQ ID NO: 105649
  derived and/or modified sequence opt2 from neuraminidase__InfluenzaA__ABU92823

SEQ ID NO: 107456 - RNA, 1410 nt, Artificial Sequence
  derived and/or modified sequence opt2 from neuraminidase__InfluenzaA__ABU92824
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgccgcaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107457 - RNA, 1410 nt, Artificial Sequence
  derived and/or modified sequence opt2 from neuraminidase__InfluenzaA__ABU92825
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107458 - RNA, 1410 nt, Artificial Sequence; identical to SEQ ID NO: 107457
  derived and/or modified sequence opt2 from neuraminidase__InfluenzaA__ABU92826

SEQ ID NO: 107459 - RNA, 1410 nt, Artificial Sequence; identical to SEQ ID NO: 105737
  derived and/or modified sequence opt2 from neuraminidase__InfluenzaA__ABU92827

SEQ ID NO: 107460 - RNA, 1410 nt, Artificial Sequence; identical to SEQ ID NO: 105737
  derived and/or modified sequence opt2 from neuraminidase__InfluenzaA__ABU92828

SEQ ID NO: 107461 - RNA, 1410 nt, Artificial Sequence; identical to SEQ ID NO: 106226
  derived and/or modified sequence opt2 from neuraminidase__InfluenzaA__ABU92829

SEQ ID NO: 107462 - RNA, 1410 nt, Artificial Sequence
  derived and/or modified sequence opt2 from neuraminidase__InfluenzaA__ABU92830
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccgcugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107463 - RNA, 1410 nt, Artificial Sequence; identical to SEQ ID NO: 105737
  derived and/or modified sequence opt2 from neuraminidase__InfluenzaA__ABU92831

SEQ ID NO: 107464 - RNA, 1410 nt, Artificial Sequence; identical to SEQ ID NO: 105737
  derived and/or modified sequence opt2 from neuraminidase__InfluenzaA__ABU92832

SEQ ID NO: 107465 - RNA, 1410 nt, Artificial Sequence; identical to SEQ ID NO: 105737
  derived and/or modified sequence opt2 from neuraminidase__InfluenzaA__ABU92833

SEQ ID NO: 107466 - RNA, 1410 nt, Artificial Sequence
  derived and/or modified sequence opt2 from neuraminidase__InfluenzaA__ABU92834
augaaccccaaccagaagaucaucaccaucggcuccgucucccucaccaucgccgccaucugcuuccucaugcacaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucucccucaugcccaucuga

SEQ ID NO: 107467 - RNA, 1410 nt, Artificial Sequence; identical to SEQ ID NO: 105737
  derived and/or modified sequence opt2 from neuraminidase__InfluenzaA__ABU92835

SEQ ID NO: 107468 - RNA, 1410 nt, Artificial Sequence; identical to SEQ ID NO: 105737
  derived and/or modified sequence opt2 from neuraminidase__InfluenzaA__ABU92836

SEQ ID NO: 107469 - RNA, 1410 nt, Artificial Sequence
  derived and/or modified sequence opt2 from neuraminidase__InfluenzaA__ABU92837
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107470 - RNA, 1410 nt, Artificial Sequence; identical to SEQ ID NO: 105737
  derived and/or modified sequence opt2 from neuraminidase__InfluenzaA__ABU92838

SEQ ID NO: 107471 - RNA, 1410 nt, Artificial Sequence; identical to SEQ ID NO: 105573
  derived and/or modified sequence opt2 from neuraminidase__InfluenzaA__ABU92839

SEQ ID NO: 107472 - RNA, 1410 nt, Artificial Sequence
  derived and/or modified sequence opt2 from neuraminidase__InfluenzaA__ABU92840
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107473 - RNA, 1410 nt, Artificial Sequence
  derived and/or modified sequence opt2 from neuraminidase__InfluenzaA__ABU92841
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107474 - RNA, 1410 nt, Artificial Sequence
  derived and/or modified sequence opt2 from neuraminidase__InfluenzaA__ABU92842
augaaccccaaccagaagaucaucaccaucggcuccgucucccucaccaucgccaccaucugcuuccucaugcagaucgccauccucgucaccaccgucacccuccacuucaagcaguacgacugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 107475 - RNA, 1410 nt, Artificial Sequence; identical to SEQ ID NO: 105573
  derived and/or modified sequence opt2 from neuraminidase__InfluenzaA__ABU92843

SEQ ID NO: 107476 - RNA, 1410 nt, Artificial Sequence; identical to SEQ ID NO: 107261
  derived and/or modified sequence opt2 from neuraminidase__InfluenzaA__ABU92844

SEQ ID NO: 107477 - RNA, 1410 nt, Artificial Sequence; identical to SEQ ID NO: 105573
  derived and/or modified sequence opt2 from neuraminidase__InfluenzaA__ABU92845

SEQ ID NO: 107478 - RNA, 1410 nt, Artificial Sequence; identical to SEQ ID NO: 105573
  derived and/or modified sequence opt2 from neuraminidase__InfluenzaA__ABU92846

SEQ ID NO: 107479 - RNA, 1410 nt, Artificial Sequence; identical to SEQ ID NO: 105573
  derived and/or modified sequence opt2 from neuraminidase__InfluenzaA__ABU92847

SEQ ID NO: 107480 - RNA, 1410 nt, Artificial Sequence; identical to SEQ ID NO: 105573
  derived and/or modified sequence opt2 from neuraminidase__InfluenzaA__ABU92848

SEQ ID NO: 107481 - RNA, 1410 nt, Artificial Sequence; identical to SEQ ID NO: 106226
  derived and/or modified sequence opt2 from neuraminidase__InfluenzaA__ABU92849

SEQ ID NO: 107482 - RNA, 1410 nt, Artificial Sequence
  derived and/or modified sequence opt2 from neuraminidase__InfluenzaA__ABU92850
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaccgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 107483 - RNA, 1410 nt, Artificial Sequence
  derived and/or modified sequence opt2 from neuraminidase__InfluenzaA__ABU92851
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcuccaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaaggacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107484 - RNA, 1410 nt, Artificial Sequence; identical to SEQ ID NO: 105737
  derived and/or modified sequence opt2 from neuraminidase__InfluenzaA__ABU92852

SEQ ID NO: 107485 - RNA, 1410 nt, Artificial Sequence
  derived and/or modified sequence opt2 from neuraminidase__InfluenzaA__ABU92853
augaaccccaaccagaagaucaucaccaucggcuccgucucccucaccaucgccgccaucugcuuccucaugcagaucgccauccucgucaccaccgucacccuccacuucaagcagcacgagugcaacuccccccccaagaaccaggucaugcucugcgagcccaccaucaucgagcgcaacaucaccgagaucgucuacaugaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107486 - RNA, 1410 nt, Artificial Sequence; identical to SEQ ID NO: 105737
  derived and/or modified sequence opt2 from neuraminidase__InfluenzaA__ABU92854

SEQ ID NO: 107487 - RNA, 1410 nt, Artificial Sequence
  derived and/or modified sequence opt2 from neuraminidase__InfluenzaA__ABU92855
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucaucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107488 - RNA, 1410 nt, Artificial Sequence; identical to SEQ ID NO: 105657
  derived and/or modified sequence opt2 from neuraminidase__InfluenzaA__ABU92856

SEQ ID NO: 107489 - RNA, 1410 nt, Artificial Sequence; identical to SEQ ID NO: 105737
  derived and/or modified sequence opt2 from neuraminidase__InfluenzaA__ABU92857

SEQ ID NO: 107490 - RNA, 1410 nt, Artificial Sequence
  derived and/or modified sequence opt2 from neuraminidase__InfluenzaA__ABU92858
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucauccucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107491 - RNA, 1410 nt, Artificial Sequence
  derived and/or modified sequence opt2 from neuraminidase__InfluenzaA__ABU92859
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccggcuaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107492 - RNA, 1410 nt, Artificial Sequence
  derived and/or modified sequence opt2 from neuraminidase__InfluenzaA__ABU92860
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguacaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucaucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107493 - RNA, 1410 nt, Artificial Sequence
  derived and/or modified sequence opt2 from neuraminidase__InfluenzaA__ABU92861
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcauggccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107494 - RNA, 1410 nt, Artificial Sequence
  derived and/or modified sequence opt2 from neuraminidase__InfluenzaA__ABU92862
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucucccgcgacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107495 - RNA, 1410 nt, Artificial Sequence; identical to SEQ ID NO: 105737
  derived and/or modified sequence opt2 from neuraminidase__InfluenzaA__ABU92863

SEQ ID NO: 107496 - RNA, 1410 nt, Artificial Sequence
  derived and/or modified sequence opt2 from neuraminidase__InfluenzaA__ABU92865
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccucgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107497 - RNA, 1410 nt, Artificial Sequence
  derived and/or modified sequence opt2 from neuraminidase__InfluenzaA__ABU92866
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccaacucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107498 - RNA, 1410 nt, Artificial Sequence; identical to SEQ ID NO: 106319
  derived and/or modified sequence opt2 from neuraminidase__InfluenzaA__ABU92867

SEQ ID NO: 107499 - RNA, 1410 nt, Artificial Sequence; identical to SEQ ID NO: 107426
  derived and/or modified sequence opt2 from neuraminidase__InfluenzaA__ABU92868

SEQ ID NO: 107500 - RNA, 1410 nt, Artificial Sequence; identical to SEQ ID NO: 106206
  derived and/or modified sequence opt2 from neuraminidase__InfluenzaA__ABU92869

SEQ ID NO: 107501 - RNA, 1410 nt, Artificial Sequence; identical to SEQ ID NO: 107396
  derived and/or modified sequence opt2 from neuraminidase__InfluenzaA__ABU92870

SEQ ID NO: 107502 - RNA, 1410 nt, Artificial Sequence
  derived and/or modified sequence opt2 from neuraminidase__InfluenzaA__ABU92872
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacaacaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107503 - RNA, 1410 nt, Artificial Sequence
  derived and/or modified sequence opt2 from neuraminidase__InfluenzaA__ABU92873
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaacaucaugcccaucuga

SEQ ID NO: 107504 - RNA, 1410 nt, Artificial Sequence; identical to SEQ ID NO: 107441
  derived and/or modified sequence opt2 from neuraminidase__InfluenzaA__ABU92874

SEQ ID NO: 107505 - RNA, 1410 nt, Artificial Sequence; identical to SEQ ID NO: 105737
  derived and/or modified sequence opt2 from neuraminidase__InfluenzaA__ABU92875

SEQ ID NO: 107506 - RNA, 1410 nt, Artificial Sequence; identical to SEQ ID NO: 105737
  derived and/or modified sequence opt2 from neuraminidase__InfluenzaA__ABU92876

SEQ ID NO: 107507 - RNA, 1410 nt, Artificial Sequence; identical to SEQ ID NO: 105657
  derived and/or modified sequence opt2 from neuraminidase__InfluenzaA__ABU92877

SEQ ID NO: 107508 - RNA, 1410 nt, Artificial Sequence; identical to SEQ ID NO: 105737
  derived and/or modified sequence opt2 from neuraminidase__InfluenzaA__ABU92878

SEQ ID NO: 107509 - RNA, 1410 nt, Artificial Sequence
  derived and/or modified sequence opt2 from neuraminidase__InfluenzaA__ABU92879
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaagggcgagaccgaggucugguggaccuccaacuccaucgucgucuucugcggcaccuccggcaccuacggcaccggcuccuggcccgacggcgccgacaucaaccucaugcccaucuga

SEQ ID NO: 107510 - RNA, 1410 nt, Artificial Sequence; identical to SEQ ID NO: 107502
  derived and/or modified sequence opt2 from neuraminidase__InfluenzaA__ABU92880

SEQ ID NO: 107511 - RNA, 1410 nt, Artificial Sequence; identical to SEQ ID NO: 105737
  derived and/or modified sequence opt2 from neuraminidase__InfluenzaA__ABU92881

SEQ ID NO: 107512 - RNA, 1410 nt, Artificial Sequence; identical to SEQ ID NO: 105737
  derived and/or modified sequence opt2 from neuraminidase__InfluenzaA__ABU92882

SEQ ID NO: 107513 - RNA, 1410 nt, Artificial Sequence
  derived and/or modified sequence opt2 from neuraminidase__InfluenzaA__ABU92883
augaaccccaaccagaagaucaucaccaucggcuccgucucccucaccaucgccgccaucugcuuccucaugcagaucgccauccucgucaccaccgucacccuccacuucaagcagcacgagugcaacuccccccccaagaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107514 - RNA, 1410 nt, Artificial Sequence; identical to SEQ ID NO: 105737
  derived and/or modified sequence opt2 from neuraminidase__InfluenzaA__ABU92884

SEQ ID NO: 107515 - RNA, 1410 nt, Artificial Sequence; identical to SEQ ID NO: 105737
  derived and/or modified sequence opt2 from neuraminidase__InfluenzaA__ABU92885

SEQ ID NO: 107516 - RNA, 1410 nt, Artificial Sequence; identical to SEQ ID NO: 106226
  derived and/or modified sequence opt2 from neuraminidase__InfluenzaA__ABU92886

SEQ ID NO: 107517 - RNA, 1410 nt, Artificial Sequence; identical to SEQ ID NO: 105737
  derived and/or modified sequence opt2 from neuraminidase__InfluenzaA__ABU92887

SEQ ID NO: 107518 - RNA, 1410 nt, Artificial Sequence
  derived and/or modified sequence opt2 from neuraminidase__InfluenzaA__ABU92888
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucaucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucgucgagggcugguccaaccccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 107519 - RNA, 1410 nt, Artificial Sequence; identical to SEQ ID NO: 107441
  derived and/or modified sequence opt2 from neuraminidase__InfluenzaA__ABU92889

SEQ ID NO: 107520 - RNA, 1410 nt, Artificial Sequence
  derived and/or modified sequence opt2 from neuraminidase__InfluenzaA__ABU92890
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucguccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107521 - RNA, 1410 nt, Artificial Sequence; identical to SEQ ID NO: 107457
  derived and/or modified sequence opt2 from neuraminidase__InfluenzaA__ABU92891

SEQ ID NO: 107522 - RNA, 1410 nt, Artificial Sequence
  derived and/or modified sequence opt2 from neuraminidase__InfluenzaA__ABU92892
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcaacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107523 - RNA, 1410 nt, Artificial Sequence; identical to SEQ ID NO: 106319
  derived and/or modified sequence opt2 from neuraminidase__InfluenzaA__ABU92893

SEQ ID NO: 107524 - RNA, 1410 nt, Artificial Sequence
  derived and/or modified sequence opt2 from neuraminidase__InfluenzaA__ABU92895
augaaccccaaccagaagaucaucaccgucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107525 - RNA, 1410 nt, Artificial Sequence
  derived and/or modified sequence opt2 from neuraminidase__InfluenzaA__ABU92896
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcaacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgaccgcaacgacgucuggaugggccgcaccaucuccgagaagucccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107526 - RNA, 1410 nt, Artificial Sequence
  derived and/or modified sequence opt2 from neuraminidase__InfluenzaA__ABU92897
augaaccccaaccagaagaucaucaccaucggcuccgucucccucaccaucuccaccaucugcuucuucaugcagaucgccauccucaucaccaccgucacccuccacuucaagcaguacgagcucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107527 - RNA, 1410 nt, Artificial Sequence
  derived and/or modified sequence opt2 from neuraminidase__InfluenzaA__ABU92898
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcaccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107528 - RNA, 1410 nt, Artificial Sequence; identical to SEQ ID NO: 105737
  derived and/or modified sequence opt2 from neuraminidase__InfluenzaA__ABU92899

SEQ ID NO: 107529 - RNA, 1410 nt, Artificial Sequence
  derived and/or modified sequence opt2 from neuraminidase__InfluenzaA__ABU92900
augaaccccaaccagaagaucaucaccaucggcuccgucucccucaccaucgccgccaucugcuuccucaugcagaucgccauccucgucaccaccgucacccuccacuucaagcagcacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107530 - RNA, 1410 nt, Artificial Sequence
  derived and/or modified sequence opt2 from neuraminidase__InfluenzaA__ABU92901
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucuccuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107531 - RNA, 1410 nt, Artificial Sequence; identical to SEQ ID NO: 105737
  derived and/or modified sequence opt2 from neuraminidase__InfluenzaA__ABU92902

SEQ ID NO: 107532 - RNA, 1410 nt, Artificial Sequence; identical to SEQ ID NO: 105737
  derived and/or modified sequence opt2 from neuraminidase__InfluenzaA__ABU92903

SEQ ID NO: 107533 - RNA, 1410 nt, Artificial Sequence; identical to SEQ ID NO: 106692
  derived and/or modified sequence opt2 from neuraminidase__InfluenzaA__ABU92904

SEQ ID NO: 107534 - RNA, 1410 nt, Artificial Sequence; identical to SEQ ID NO: 105737
  derived and/or modified sequence opt2 from neuraminidase__InfluenzaA__ABU92905

SEQ ID NO: 107535 - RNA, 1410 nt, Artificial Sequence
  derived and/or modified sequence opt2 from neuraminidase__InfluenzaA__ABU92906
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaagcucaugcccaucuga

SEQ ID NO: 107536 - RNA, 1410 nt, Artificial Sequence
  derived and/or modified sequence opt2 from neuraminidase__InfluenzaA__ABU92907
augaaccccaaccagaagaucaucaccaucggcuccaucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 107537 - RNA, 1410 nt, Artificial Sequence; identical to SEQ ID NO: 105737
  derived and/or modified sequence opt2 from neuraminidase__InfluenzaA__ABU92908

SEQ ID NO: 107538 - RNA, 1410 nt, Artificial Sequence; identical to SEQ ID NO: 105737
  derived and/or modified sequence opt2 from neuraminidase__InfluenzaA__ABU92909

SEQ ID NO: 107539 - RNA, 1410 nt, Artificial Sequence
  derived and/or modified sequence opt2 from neuraminidase__InfluenzaA__ABU92910
augaaccccaaccagaagaucaucaccaucggcuccgucucccucaccaucgccaccaucugcuuccucacccagaucgccauccucaucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacguccgcgacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgacaagggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 107540 - RNA, 1410 nt, Artificial Sequence
  derived and/or modified sequence opt2 from neuraminidase__InfluenzaA__ABU92911
augaaccccaaccagaagaucaucaccaucggcuccgucucccucaccaucgccaccaucugcuuccucacccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcaggccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucaaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 107541 - RNA, 1410 nt, Artificial Sequence
  derived and/or modified sequence opt2 from neuraminidase__InfluenzaA__ABU92913
augaaccccaaccagaagaucaucaccaucggcuccgucucccucaccaucgccaccaucugcuuccucacccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucaaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 107542 - RNA, 1413 nt, Artificial Sequence
  derived and/or modified sequence opt2 from neuraminidase__InfluenzaA__ABV29560
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107543 - RNA, 1413 nt, Artificial Sequence; identical to SEQ ID NO: 107542
  derived and/or modified sequence opt2 from neuraminidase__InfluenzaA__ABV29571

SEQ ID NO: 107544 - RNA, 1413 nt, Artificial Sequence; identical to SEQ ID NO: 107542
  derived and/or modified sequence opt2 from neuraminidase__InfluenzaA__ABV29582

SEQ ID NO: 107545 - RNA, 1413 nt, Artificial Sequence; identical to SEQ ID NO: 107542
  derived and/or modified sequence opt2 from neuraminidase__InfluenzaA__ABV29615

SEQ ID NO: 107546 - RNA, 1413 nt, Artificial Sequence
  derived and/or modified sequence opt2 from neuraminidase__InfluenzaA__ABV29637
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcaccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucuccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107547 - RNA, 1413 nt, Artificial Sequence; identical to SEQ ID NO: 107542
  derived and/or modified sequence opt2 from neuraminidase__InfluenzaA__ABV29648

SEQ ID NO: 107548 - RNA, 1413 nt, Artificial Sequence; identical to SEQ ID NO: 107542
  derived and/or modified sequence opt2 from neuraminidase__InfluenzaA__ABV29659

SEQ ID NO: 107549 - RNA, 1413 nt, Artificial Sequence; identical to SEQ ID NO: 107542
  derived and/or modified sequence opt2 from neuraminidase__InfluenzaA__ABV29670

SEQ ID NO: 107550 - RNA, 1413 nt, Artificial Sequence
  derived and/or modified sequence opt2 from neuraminidase__InfluenzaA__ABV29681
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcaucgacuccgacaccgccaacugguccuggcccgacggcgccgagcuccccuucaccaucgacaaguga

SEQ ID NO: 107551 - RNA, 1413 nt, Artificial Sequence; identical to SEQ ID NO: 107542
  derived and/or modified sequence opt2 from neuraminidase__InfluenzaA__ABV29692

SEQ ID NO: 107552 - RNA, 1413 nt, Artificial Sequence; identical to SEQ ID NO: 107542
  derived and/or modified sequence opt2 from neuraminidase__InfluenzaA__ABV29703

SEQ ID NO: 107553 - RNA, 1410 nt, Artificial Sequence
  derived and/or modified sequence opt2 from neuraminidase__InfluenzaA__ABV29714
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107554 - RNA, 1410 nt, Artificial Sequence
  derived and/or modified sequence opt2 from neuraminidase__InfluenzaA__ABV29725
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccagggcaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuucccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107555 - RNA, 1413 nt, Artificial Sequence
  derived and/or modified sequence opt2 from neuraminidase__InfluenzaA__ABV29736
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucaccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccgacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacaacgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107556 - RNA, 1413 nt, Artificial Sequence
  derived and/or modified sequence opt2 from neuraminidase__InfluenzaA__ABV29747
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccguccgccaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107557 - RNA, 1413 nt, Artificial Sequence; identical to SEQ ID NO: 107542
  derived and/or modified sequence opt2 from neuraminidase__InfluenzaA__ABV29769

SEQ ID NO: 107558 - RNA, 1413 nt, Artificial Sequence
  derived and/or modified sequence opt2 from neuraminidase__InfluenzaA__ABV29780
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucaccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccgacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccuccaagcuccgcaagggcuucgagaugaucugggaccccaacggcuggaccgacaccgacaacgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107559 - RNA, 1413 nt, Artificial Sequence; identical to SEQ ID NO: 107542
  derived and/or modified sequence opt2 from neuraminidase__InfluenzaA__ABV29791

SEQ ID NO: 107560 - RNA, 1413 nt, Artificial Sequence; identical to SEQ ID NO: 107542
  derived and/or modified sequence opt2 from neuraminidase__InfluenzaA__ABV29802

SEQ ID NO: 107561 - RNA, 1410 nt, Artificial Sequence; identical to SEQ ID NO: 107396
  derived and/or modified sequence opt2 from neuraminidase__InfluenzaA__ABV29824

SEQ ID NO: 107562 - RNA, 1413 nt, Artificial Sequence; identical to SEQ ID NO: 107542
  derived and/or modified sequence opt2 from neuraminidase__InfluenzaA__ABV29835

SEQ ID NO: 107563 - RNA, 1413 nt, Artificial Sequence
  derived and/or modified sequence opt2 from neuraminidase__InfluenzaA__ABV29846
augaaccccaaccagaagaucaucaccaucggcuccaucuccaucgccaucggcaucaucucccucaugcuccagaucggcaacaucaucuccaucugggccucccacuccauccagaucggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107564 - RNA, 1413 nt, Artificial Sequence
  derived and/or modified sequence opt2 from neuraminidase__InfluenzaA__ABV29879
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucaucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107565 - RNA, 1413 nt, Artificial Sequence; identical to SEQ ID NO: 107542
  derived and/or modified sequence opt2 from neuraminidase__InfluenzaA__ABV29890

SEQ ID NO: 107566 - RNA, 1410 nt, Artificial Sequence; identical to SEQ ID NO: 107396
  derived and/or modified sequence opt2 from neuraminidase__InfluenzaA__ABV29901

SEQ ID NO: 107567 - RNA, 1410 nt, Artificial Sequence
  derived and/or modified sequence opt2 from neuraminidase__InfluenzaA__ABV29912
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggacauccuccgcacccaggaguccgagugcaucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107568 - RNA, 1413 nt, Artificial Sequence
  derived and/or modified sequence opt2 from neuraminidase__InfluenzaA__ABV29923
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacgccaccaucuggaccuccggcuccuccaucuccuucugcggcgucgacuccgacaccgccaacugguccuggcccgacggcgccgagcuccccuucaccaucgacaaguga

SEQ ID NO: 107569 - RNA, 1410 nt, Artificial Sequence
  derived and/or modified sequence opt2 from neuraminidase__InfluenzaA__ABV29934
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcaccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107570 - RNA, 1413 nt, Artificial Sequence; identical to SEQ ID NO: 107555
  derived and/or modified sequence opt2 from neuraminidase__InfluenzaA__ABV29945

SEQ ID NO: 107571 - RNA, 1413 nt, Artificial Sequence
  derived and/or modified sequence opt2 from neuraminidase__InfluenzaA__ABV29956
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaagggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107572 - RNA, 1413 nt, Artificial Sequence
  derived and/or modified sequence opt2 from neuraminidase__InfluenzaA__ABV29989
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucaugcgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107573 - RNA, 1413 nt, Artificial Sequence; identical to SEQ ID NO: 107542
  derived and/or modified sequence opt2 from neuraminidase__InfluenzaA__ABV30000

SEQ ID NO: 107574 - RNA, 1413 nt, Artificial Sequence; identical to SEQ ID NO: 107542
  derived and/or modified sequence opt2 from neuraminidase__InfluenzaA__ABV30011

SEQ ID NO: 107575 - RNA, 1413 nt, Artificial Sequence; identical to SEQ ID NO: 107542
  derived and/or modified sequence opt2 from neuraminidase__InfluenzaA__ABV30022

SEQ ID NO: 107576 - RNA, 1413 nt, Artificial Sequence
  derived and/or modified sequence opt2 from neuraminidase__InfluenzaA__ABV30044
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccggcacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107577 - RNA, 1413 nt, Artificial Sequence
  derived and/or modified sequence opt2 from neuraminidase__InfluenzaA__ABV30055
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107578 - RNA, 1410 nt, Artificial Sequence
  derived and/or modified sequence opt2 from neuraminidase__InfluenzaA__ABV30077
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107579 - RNA, 1413 nt, Artificial Sequence; identical to SEQ ID NO: 107542
  derived and/or modified sequence opt2 from neuraminidase__InfluenzaA__ABV30088

SEQ ID NO: 107580 - RNA, 1413 nt, Artificial Sequence; identical to SEQ ID NO: 107542
  derived and/or modified sequence opt2 from neuraminidase__InfluenzaA__ABV30099

SEQ ID NO: 107581 - RNA, 1413 nt, Artificial Sequence
  derived and/or modified sequence opt2 from neuraminidase__InfluenzaA__ABV30110
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107582 - RNA, 1413 nt, Artificial Sequence; identical to SEQ ID NO: 107542
  derived and/or modified sequence opt2 from neuraminidase__InfluenzaA__ABV30132

SEQ ID NO: 107583 - RNA, 1413 nt, Artificial Sequence
  derived and/or modified sequence opt2 from neuraminidase__InfluenzaA__ABV30143
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107584 - RNA, 1413 nt, Artificial Sequence; identical to SEQ ID NO: 107568
  derived and/or modified sequence opt2 from neuraminidase__InfluenzaA__ABV30154

SEQ ID NO: 107585 - RNA, 1413 nt, Artificial Sequence
  derived and/or modified sequence opt2 from neuraminidase__InfluenzaA__ABV30165
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaaccucucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107586 - RNA, 1413 nt, Artificial Sequence; identical to SEQ ID NO: 107542
  derived and/or modified sequence opt2 from neuraminidase__InfluenzaA__ABV30187

SEQ ID NO: 107587 - RNA, 1413 nt, Artificial Sequence; identical to SEQ ID NO: 107542
  derived and/or modified sequence opt2 from neuraminidase__InfluenzaA__ABV30198

SEQ ID NO: 107588 - RNA, 1410 nt, Artificial Sequence; identical to SEQ ID NO: 107396
  derived and/or modified sequence opt2 from neuraminidase__InfluenzaA__ABV30209

SEQ ID NO: 107589 - RNA, 1410 nt, Artificial Sequence; identical to SEQ ID NO: 107578
  derived and/or modified sequence opt2 from neuraminidase__InfluenzaA__ABV30220

SEQ ID NO: 107590 - RNA, 1410 nt, Artificial Sequence; identical to SEQ ID NO: 107578
  derived and/or modified sequence opt2 from neuraminidase__InfluenzaA__ABV30231

SEQ ID NO: 107591 - RNA, 1410 nt, Artificial Sequence
  derived and/or modified sequence opt2 from neuraminidase__InfluenzaA__ABV30264
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgaggucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107592 - RNA, 1410 nt, Artificial Sequence
  derived and/or modified sequence opt2 from neuraminidase__InfluenzaA__ABV30275
augaaccccaaccagaagaucaucaccaucggcuccgucucccucaccaucuccaccaucugcuucuucaugcagaccgccauccucaucaccaccgucacccuccacuucaagcaguacgaguucaacuccacccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107593 - RNA, 1413 nt, Artificial Sequence; identical to SEQ ID NO: 107583
  derived and/or modified sequence opt2 from neuraminidase__InfluenzaA__ABV30297

SEQ ID NO: 107594 - RNA, 1413 nt, Artificial Sequence
  derived and/or modified sequence opt2 from neuraminidase__InfluenzaA__ABV30308
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugccucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107595 - RNA, 1413 nt, Artificial Sequence
  derived and/or modified sequence opt2 from neuraminidase__InfluenzaA__ABV30319
augaaccccaaccagaagaucaucaccaucggcuccaucuccaucgccaucggcaucaucucccucaugcuccagaucggcaacaucgucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107596 - RNA, 1413 nt, Artificial Sequence; identical to SEQ ID NO: 107583
  derived and/or modified sequence opt2 from neuraminidase__InfluenzaA__ABV30330

SEQ ID NO: 107597 - RNA, 1413 nt, Artificial Sequence; identical to SEQ ID NO: 107542
  derived and/or modified sequence opt2 from neuraminidase__InfluenzaA__ABV30341

SEQ ID NO: 107598 - RNA, 1413 nt, Artificial Sequence; identical to SEQ ID NO: 107542
  derived and/or modified sequence opt2 from neuraminidase__InfluenzaA__ABV30363

SEQ ID NO: 107599 - RNA, 1413 nt, Artificial Sequence; identical to SEQ ID NO: 107542
  derived and/or modified sequence opt2 from neuraminidase__InfluenzaA__ABV30374

SEQ ID NO: 107600 - RNA, 1410 nt, Artificial Sequence
  derived and/or modified sequence opt2 from neuraminidase__InfluenzaA__ABV30385
augaaccccaaccagaagaucaucaccaucggcuccgucucccucaccaucuccaccaucugcuucuucaugcagaucgccauccucaucaccaccgucacccuccacuucaagcaguacgaguucucccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107601 - RNA, 1410 nt, Artificial Sequence
  derived and/or modified sequence opt2 from neuraminidase__InfluenzaA__ABV30396
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucuccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 107602 - RNA, 1410 nt, Artificial Sequence
  derived and/or modified sequence opt2 from neuraminidase__InfluenzaA__ABV30407
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107603 - RNA, 1410 nt, Artificial Sequence
  derived and/or modified sequence opt2 from neuraminidase__InfluenzaA__ABV30418
augaaccccaaccagaagaucaucaccaucggcuccgucucccucaccaucuccaccaucugcuucuucaugcagaucgccauccucaucaccaccgucacccuccacuucaagcaguacgaguucuccucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgccgcgaggagaccgagguccucuggaccuccaacuccaucgucgucuucugcggcaccuccggcaccuacggcaccggcuccuggcccgacggcgccgacaucaaccucaugcccaucuga

SEQ ID NO: 107604 - RNA, 1410 nt, Artificial Sequence; identical to SEQ ID NO: 107569
  derived and/or modified sequence opt2 from neuraminidase__InfluenzaA__ABV30429

SEQ ID NO: 107605 - RNA, 1410 nt, Artificial Sequence; identical to SEQ ID NO: 107569
  derived and/or modified sequence opt2 from neuraminidase__InfluenzaA__ABV30440

SEQ ID NO: 107606 - RNA, 1410 nt, Artificial Sequence; identical to SEQ ID NO: 107569
  derived and/or modified sequence opt2 from neuraminidase__InfluenzaA__ABV30451

SEQ ID NO: 107607 - RNA, 1413 nt, Artificial Sequence; identical to SEQ ID NO: 107542
  derived and/or modified sequence opt2 from neuraminidase__InfluenzaA__ABV30462

SEQ ID NO: 107608 - RNA, 1410 nt, Artificial Sequence; identical to SEQ ID NO: 107569
  derived and/or modified sequence opt2 from neuraminidase__InfluenzaA__ABV30473

SEQ ID NO: 107609 - RNA, 1410 nt, Artificial Sequence
  derived and/or modified sequence opt2 from neuraminidase__InfluenzaA__ABV30484
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccaacucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107610 - RNA, 1413 nt, Artificial Sequence; identical to SEQ ID NO: 107581
  derived and/or modified sequence opt2 from neuraminidase__InfluenzaA__ABV30495

SEQ ID NO: 107611 - RNA, 1413 nt, Artificial Sequence; identical to SEQ ID NO: 107542
  derived and/or modified sequence opt2 from neuraminidase__InfluenzaA__ABV30506

SEQ ID NO: 107612 - RNA, 1410 nt, Artificial Sequence; identical to SEQ ID NO: 107578
  derived and/or modified sequence opt2 from neuraminidase__InfluenzaA__ABV30517

SEQ ID NO: 107613 - RNA, 1413 nt, Artificial Sequence
  derived and/or modified sequence opt2 from neuraminidase__InfluenzaA__ABV30528
augaacuccaaccagaagaucaucaccaucggcuccaucuccaucgccaucggcaucaucucccucaugcuccagaucggcaacaucaucuccaugugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacgccaccaucuggaccuccggcuccuccaucuccuucugcggcgucgacuccgacaccgccaacugguccuggcccgacggcgccgagcuccccuucaccaucgacaaguga

SEQ ID NO: 107614 - RNA, 1413 nt, Artificial Sequence; identical to SEQ ID NO: 107542
  derived and/or modified sequence opt2 from neuraminidase__InfluenzaA__ABV30539

SEQ ID NO: 107615 - RNA, 1413 nt, Artificial Sequence; identical to SEQ ID NO: 107542
  derived and/or modified sequence opt2 from neuraminidase__InfluenzaA__ABV30561

SEQ ID NO: 107616 - RNA, 1413 nt, Artificial Sequence; identical to SEQ ID NO: 107542
  derived and/or modified sequence opt2 from neuraminidase__InfluenzaA__ABV30572

SEQ ID NO: 107617 - RNA, 1413 nt, Artificial Sequence; identical to SEQ ID NO: 107542
  derived and/or modified sequence opt2 from neuraminidase__InfluenzaA__ABV30583

SEQ ID NO: 107618 - RNA, 1413 nt, Artificial Sequence; identical to SEQ ID NO: 107542
  derived and/or modified sequence opt2 from neuraminidase__InfluenzaA__ABV30594

SEQ ID NO: 107619 - RNA, 1413 nt, Artificial Sequence
  derived and/or modified sequence opt2 from neuraminidase__InfluenzaA__ABV30605
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgucggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107620 - RNA, 1413 nt, Artificial Sequence; identical to SEQ ID NO: 107542
  derived and/or modified sequence opt2 from neuraminidase__InfluenzaA__ABV30616

SEQ ID NO: 107621 - RNA, 1413 nt, Artificial Sequence; identical to SEQ ID NO: 107542
  derived and/or modified sequence opt2 from neuraminidase__InfluenzaA__ABV30627

SEQ ID NO: 107622 - RNA, 1410 nt, Artificial Sequence
  derived and/or modified sequence opt2 from neuraminidase__InfluenzaA__ABV30649
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaacgccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107623 - RNA, 1410 nt, Artificial Sequence; identical to SEQ ID NO: 107396
  derived and/or modified sequence opt2 from neuraminidase__InfluenzaA__ABV30660

SEQ ID NO: 107624 - RNA, 1413 nt, Artificial Sequence
  derived and/or modified sequence opt2 from neuraminidase__InfluenzaA__ABV45852
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccaacaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107625 - RNA, 1410 nt, Artificial Sequence; identical to SEQ ID NO: 107396
  derived and/or modified sequence opt2 from neuraminidase__InfluenzaA__ABV45863

SEQ ID NO: 107626 - RNA, 1413 nt, Artificial Sequence
  derived and/or modified sequence opt2 from neuraminidase__InfluenzaA__ABV45874
augaaccccaaccagaagaucaucaccaucggcuccaucuccaucgccaucggcaucaucucccucaugcuccagaucggcaacaucaucuccaucugggccuccuacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107627 - RNA, 1413 nt, Artificial Sequence; identical to SEQ ID NO: 107542
  derived and/or modified sequence opt2 from neuraminidase__InfluenzaA__ABV45885

SEQ ID NO: 107628 - RNA, 1413 nt, Artificial Sequence; identical to SEQ ID NO: 107555
  derived and/or modified sequence opt2 from neuraminidase__InfluenzaA__ABV45896

SEQ ID NO: 107629 - RNA, 1413 nt, Artificial Sequence; identical to SEQ ID NO: 107542
  derived and/or modified sequence opt2 from neuraminidase__InfluenzaA__ABV45918

SEQ ID NO: 107630 - RNA, 1413 nt, Artificial Sequence
  derived and/or modified sequence opt2 from neuraminidase__InfluenzaA__ABV45929
augaaccccaaccagaagaucaucaccaucggcuccaucuccaucgccaucggcaucaucucccucaugcuccagaucggcaacaucaucuccaugugggccucccacuccauccagaccggcucccagaaccacaccggcaucugcaaccagcgcaucaucaccuacgagaacuccaccugggucaaccacaccuacgucaacaucaacaacaccaacgucgucaccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccgacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacaacgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacgccaccaucuggaccuccggcuccuccaucuccuucugcggcgucgacuccgacaccgccaacugguccuggcccgacggcgccgagcuccccuucaccaucgacaaguga

SEQ ID NO: 107631 - RNA, 1413 nt, Artificial Sequence
  derived and/or modified sequence opt2 from neuraminidase__InfluenzaA__ABV45940
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucauccgcuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagucccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107632 - RNA, 1413 nt, Artificial Sequence; identical to SEQ ID NO: 107568
  derived and/or modified sequence opt2 from neuraminidase__InfluenzaA__ABV45951

SEQ ID NO: 107633 - RNA, 1410 nt, Artificial Sequence
  derived and/or modified sequence opt2 from neuraminidase__InfluenzaA__ABV45973
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 107634 - RNA, 1410 nt, Artificial Sequence
  derived and/or modified sequence opt2 from neuraminidase__InfluenzaA__ABV45984
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107635 - RNA, 1410 nt, Artificial Sequence; identical to SEQ ID NO: 107396
  derived and/or modified sequence opt2 from neuraminidase__InfluenzaA__ABV45995

SEQ ID NO: 107636 - RNA, 1413 nt, Artificial Sequence; identical to SEQ ID NO: 107555
  derived and/or modified sequence opt2 from neuraminidase__InfluenzaA__ABV82554

SEQ ID NO: 107637 - RNA, 1410 nt, Artificial Sequence; identical to SEQ ID NO: 107578
  derived and/or modified sequence opt2 from neuraminidase__InfluenzaA__ABV82565

SEQ ID NO: 107638 - RNA, 1410 nt, Artificial Sequence; identical to SEQ ID NO: 107578
  derived and/or modified sequence opt2 from neuraminidase__InfluenzaA__ABW36171

SEQ ID NO: 107639 - RNA, 1413 nt, Artificial Sequence; identical to SEQ ID NO: 107594
  derived and/or modified sequence opt2 from neuraminidase__InfluenzaA__ABW36193

SEQ ID NO: 107640 - RNA, 1413 nt, Artificial Sequence; identical to SEQ ID NO: 107542
  derived and/or modified sequence opt2 from neuraminidase__InfluenzaA__ABW36204

SEQ ID NO: 107641 - RNA, 1413 nt, Artificial Sequence
  derived and/or modified sequence opt2 from neuraminidase__InfluenzaA__ABW36215
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaagggcuggcucaccaucggcaucuccggccccgacaacggcgccgucgccguccucaaguacaacggcaucaucaccgagaccaucaaguccuggaacaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggccgcggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacucccacuucuccgucaagcaggacgucgucgccaucaccgacugguccggcuacuccggcuccuucguccagcaccccgagcucaccggccucgacugcaucaagcccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaucaucgacaaguga

SEQ ID NO: 107642 - RNA, 1413 nt, Artificial Sequence; identical to SEQ ID NO: 107542
  derived and/or modified sequence opt2 from neuraminidase__InfluenzaA__ABW36226

SEQ ID NO: 107643 - RNA, 1413 nt, Artificial Sequence
  derived and/or modified sequence opt2 from neuraminidase__InfluenzaA__ABW36237
augaaccccaaccagaagaucaucaccaucggcuccaucuccaucaccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107644 - RNA, 1413 nt, Artificial Sequence; identical to SEQ ID NO: 107542
  derived and/or modified sequence opt2 from neuraminidase__InfluenzaA__ABW36248

SEQ ID NO: 107645 - RNA, 1413 nt, Artificial Sequence
  derived and/or modified sequence opt2 from neuraminidase__InfluenzaA__ABW36259
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaaccgcgccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcguccucggcgacaacccccgccccgaggacggcgagggcuccugcaaccccgucaccgucgacggcgccgacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucuccuccgacaccgccaacugguccuggcccgacggcgccgagcuccccuucaccaucgacaaguga

SEQ ID NO: 107646 - RNA, 1413 nt, Artificial Sequence; identical to SEQ ID NO: 107542
  derived and/or modified sequence opt2 from neuraminidase__InfluenzaA__ABW36281

SEQ ID NO: 107647 - RNA, 1413 nt, Artificial Sequence; identical to SEQ ID NO: 107542
  derived and/or modified sequence opt2 from neuraminidase__InfluenzaA__ABW36292

SEQ ID NO: 107648 - RNA, 1413 nt, Artificial Sequence; identical to SEQ ID NO: 107555
  derived and/or modified sequence opt2 from neuraminidase__InfluenzaA__ABW36303

SEQ ID NO: 107649 - RNA, 1413 nt, Artificial Sequence
  derived and/or modified sequence opt2 from neuraminidase__InfluenzaA__ABW36314
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccaggccuccuaccgcaucuucaagaucgagaagggcaagaucaccaaguccaucgagcucgacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107650 - RNA, 1410 nt, Artificial Sequence
  derived and/or modified sequence opt2 from neuraminidase__InfluenzaA__ABW38366
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgccuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107651 - RNA, 1413 nt, Artificial Sequence; identical to SEQ ID NO: 107641
  derived and/or modified sequence opt2 from neuraminidase__InfluenzaA__ABW39780

SEQ ID NO: 107652 - RNA, 1413 nt, Artificial Sequence
  derived and/or modified sequence opt2 from neuraminidase__InfluenzaA__ABW39809
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagacccucgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107653 - RNA, 1413 nt, Artificial Sequence; identical to SEQ ID NO: 107555
  derived and/or modified sequence opt2 from neuraminidase__InfluenzaA__ABW39820

SEQ ID NO: 107654 - RNA, 1413 nt, Artificial Sequence
  derived and/or modified sequence opt2 from neuraminidase__InfluenzaA__ABW39831
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 107655 - RNA, 1413 nt, Artificial Sequence; identical to SEQ ID NO: 107568
  derived and/or modified sequence opt2 from neuraminidase__InfluenzaA__ABW39842

SEQ ID NO: 107656 - RNA, 1413 nt, Artificial Sequence; identical to SEQ ID NO: 107542
  derived and/or modified sequence opt2 from neuraminidase__InfluenzaA__ABW39864

SEQ ID NO: 107657 - RNA, 1410 nt, Artificial Sequence; identical to SEQ ID NO: 107578
  derived and/or modified sequence opt2 from neuraminidase__InfluenzaA__ABW39875

SEQ ID NO: 107658 - RNA, 1413 nt, Artificial Sequence
  derived and/or modified sequence opt2 from neuraminidase__InfluenzaA__ABW39886
augaaccccaaccagaagaucaucaccaucggcuccaucuccaucgccaucggcaucaucucccucauccuccagaucggcaacaucaucuccaucugggccucccacuccauccagacccgcaaccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107659 - RNA, 1413 nt, Artificial Sequence; identical to SEQ ID NO: 107542
  derived and/or modified sequence opt2 from neuraminidase__InfluenzaA__ABW39897

SEQ ID NO: 107660 - RNA, 1413 nt, Artificial Sequence
  derived and/or modified sequence opt2 from neuraminidase__InfluenzaA__ABW39908
augaaccccaaccagaagaucaucaccaucggcuccaucuccaucgccaucggcaucaccucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107661 - RNA, 1413 nt, Artificial Sequence
  derived and/or modified sequence opt2 from neuraminidase__InfluenzaA__ABW39930
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccgacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107662 - RNA, 1413 nt, Artificial Sequence
  derived and/or modified sequence opt2 from neuraminidase__InfluenzaA__ABW39952
augaaccccaaccagaagaucaucaccaucggcuccaucuccaucaccaucggcaucaucucccucaugcuccagaucggcaacaucaucuccaucugggccucccacuccauccagaccggcucccagaaccacaccggcaugugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107663 - RNA, 1413 nt, Artificial Sequence; identical to SEQ ID NO: 107542
  derived and/or modified sequence opt2 from neuraminidase__InfluenzaA__ABW39963

SEQ ID NO: 107664 - RNA, 1413 nt, Artificial Sequence; identical to SEQ ID NO: 107542
  derived and/or modified sequence opt2 from neuraminidase__InfluenzaA__ABW39985

SEQ ID NO: 107665 - RNA, 1413 nt, Artificial Sequence
  derived and/or modified sequence opt2 from neuraminidase__InfluenzaA__ABW39996
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcaccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107666 - RNA, 1413 nt, Artificial Sequence; identical to SEQ ID NO: 107542
  derived and/or modified sequence opt2 from neuraminidase__InfluenzaA__ABW40007

SEQ ID NO: 107667 - RNA, 1413 nt, Artificial Sequence
  derived and/or modified sequence opt2 from neuraminidase__InfluenzaA__ABW40018
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcaucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacggcgacaccgccaacugguccuggcccgacggcgccgagcuccccuucaccaucgacaaguga

SEQ ID NO: 107668 - RNA, 1410 nt, Artificial Sequence; identical to SEQ ID NO: 107396
  derived and/or modified sequence opt2 from neuraminidase__InfluenzaA__ABW40029

SEQ ID NO: 107669 - RNA, 1413 nt, Artificial Sequence
  derived and/or modified sequence opt2 from neuraminidase__InfluenzaA__ABW40040
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcaucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107670 - RNA, 1413 nt, Artificial Sequence; identical to SEQ ID NO: 107542
  derived and/or modified sequence opt2 from neuraminidase__InfluenzaA__ABW40051

SEQ ID NO: 107671 - RNA, 1413 nt, Artificial Sequence; identical to SEQ ID NO: 107542
  derived and/or modified sequence opt2 from neuraminidase__InfluenzaA__ABW40062

SEQ ID NO: 107672 - RNA, 1410 nt, Artificial Sequence; identical to SEQ ID NO: 107578
  derived and/or modified sequence opt2 from neuraminidase__InfluenzaA__ABW40084

SEQ ID NO: 107673 - RNA, 1413 nt, Artificial Sequence
  derived and/or modified sequence opt2 from neuraminidase__InfluenzaA__ABW40095
augaaccccaaccagaagaucaucaccaucggcuccaucuccgucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107674 - RNA, 1413 nt, Artificial Sequence
  derived and/or modified sequence opt2 from neuraminidase__InfluenzaA__ABW40106
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugccucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagauggucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107675 - RNA, 1413 nt, Artificial Sequence; identical to SEQ ID NO: 107542
  derived and/or modified sequence opt2 from neuraminidase__InfluenzaA__ABW40117

SEQ ID NO: 107676 - RNA, 1413 nt, Artificial Sequence; identical to SEQ ID NO: 107542
  derived and/or modified sequence opt2 from neuraminidase__InfluenzaA__ABW40128

SEQ ID NO: 107677 - RNA, 1410 nt, Artificial Sequence; identical to SEQ ID NO: 107396
  derived and/or modified sequence opt2 from neuraminidase__InfluenzaA__ABW40139

SEQ ID NO: 107678 - RNA, 1413 nt, Artificial Sequence; identical to SEQ ID NO: 107542
  derived and/or modified sequence opt2 from neuraminidase__InfluenzaA__ABW40150

SEQ ID NO: 107679 - RNA, 1413 nt, Artificial Sequence; identical to SEQ ID NO: 107542
  derived and/or modified sequence opt2 from neuraminidase__InfluenzaA__ABW40161

SEQ ID NO: 107680 - RNA, 1410 nt, Artificial Sequence
  derived and/or modified sequence opt2 from neuraminidase__InfluenzaA__ABW40172
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucacccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107681 - RNA, 1413 nt, Artificial Sequence; identical to SEQ ID NO: 107542
  derived and/or modified sequence opt2 from neuraminidase__InfluenzaA__ABW40183

SEQ ID NO: 107682 - RNA, 1410 nt, Artificial Sequence; identical to SEQ ID NO: 107396
  derived and/or modified sequence opt2 from neuraminidase__InfluenzaA__ABW40194

SEQ ID NO: 107683 - RNA, 1413 nt, Artificial Sequence; identical to SEQ ID NO: 107577
  derived and/or modified sequence opt2 from neuraminidase__InfluenzaA__ABW40205

SEQ ID NO: 107684 - RNA, 1413 nt, Artificial Sequence; identical to SEQ ID NO: 107581
  derived and/or modified sequence opt2 from neuraminidase__InfluenzaA__ABW40216

SEQ ID NO: 107685 - RNA, 1413 nt, Artificial Sequence; identical to SEQ ID NO: 107581
  derived and/or modified sequence opt2 from neuraminidase__InfluenzaA__ABW40227

SEQ ID NO: 107686 - RNA, 1413 nt, Artificial Sequence; identical to SEQ ID NO: 107542
  derived and/or modified sequence opt2 from neuraminidase__InfluenzaA__ABW40238

SEQ ID NO: 107687 - RNA, 1410 nt, Artificial Sequence
  derived and/or modified sequence opt2 from neuraminidase__InfluenzaA__ABW40249
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107688 - RNA, 1413 nt, Artificial Sequence; identical to SEQ ID NO: 107542
  derived and/or modified sequence opt2 from neuraminidase__InfluenzaA__ABW40260

SEQ ID NO: 107689 - RNA, 1410 nt, Artificial Sequence
  derived and/or modified sequence opt2 from neuraminidase__InfluenzaA__ABW40271
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgagcaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107690 - RNA, 1413 nt, Artificial Sequence; identical to SEQ ID NO: 107542
  derived and/or modified sequence opt2 from neuraminidase__InfluenzaA__ABW40282

SEQ ID NO: 107691 - RNA, 1413 nt, Artificial Sequence; identical to SEQ ID NO: 107577
  derived and/or modified sequence opt2 from neuraminidase__InfluenzaA__ABW40293

SEQ ID NO: 107692 - RNA, 1413 nt, Artificial Sequence; identical to SEQ ID NO: 107542
  derived and/or modified sequence opt2 from neuraminidase__InfluenzaA__ABW40304

SEQ ID NO: 107693 - RNA, 1413 nt, Artificial Sequence; identical to SEQ ID NO: 107542
  derived and/or modified sequence opt2 from neuraminidase__InfluenzaA__ABW40315

SEQ ID NO: 107694 - RNA, 1410 nt, Artificial Sequence; identical to SEQ ID NO: 107396
  derived and/or modified sequence opt2 from neuraminidase__InfluenzaA__ABW40326

SEQ ID NO: 107695 - RNA, 1413 nt, Artificial Sequence; identical to SEQ ID NO: 107583
  derived and/or modified sequence opt2 from neuraminidase__InfluenzaA__ABW40337

SEQ ID NO: 107696 - RNA, 1413 nt, Artificial Sequence; identical to SEQ ID NO: 107577
  derived and/or modified sequence opt2 from neuraminidase__InfluenzaA__ABW40359

SEQ ID NO: 107697 - RNA, 1413 nt, Artificial Sequence
  derived and/or modified sequence opt2 from neuraminidase__InfluenzaA__ABW40370
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacuccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107698 - RNA, 1413 nt, Artificial Sequence; identical to SEQ ID NO: 107542
  derived and/or modified sequence opt2 from neuraminidase__InfluenzaA__ABW40403

SEQ ID NO: 107699 - RNA, 1413 nt, Artificial Sequence
  derived and/or modified sequence opt2 from neuraminidase__InfluenzaA__ABW40414
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucgaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107700 - RNA, 1413 nt, Artificial Sequence; identical to SEQ ID NO: 107542
  derived and/or modified sequence opt2 from neuraminidase__InfluenzaA__ABW40425

SEQ ID NO: 107701 - RNA, 1413 nt, Artificial Sequence; identical to SEQ ID NO: 107583
  derived and/or modified sequence opt2 from neuraminidase__InfluenzaA__ABW40436

SEQ ID NO: 107702 - RNA, 1413 nt, Artificial Sequence
  derived and/or modified sequence opt2 from neuraminidase__InfluenzaA__ABW40447
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucaacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107703 - RNA, 1413 nt, Artificial Sequence; identical to SEQ ID NO: 107568
  derived and/or modified sequence opt2 from neuraminidase__InfluenzaA__ABW40458

SEQ ID NO: 107704 - RNA, 1413 nt, Artificial Sequence; identical to SEQ ID NO: 107542
  derived and/or modified sequence opt2 from neuraminidase__InfluenzaA__ABW40469

SEQ ID NO: 107705 - RNA, 1413 nt, Artificial Sequence; identical to SEQ ID NO: 107542
  derived and/or modified sequence opt2 from neuraminidase__InfluenzaA__ABW40491

SEQ ID NO: 107706 - RNA, 1413 nt, Artificial Sequence; identical to SEQ ID NO: 107542
  derived and/or modified sequence opt2 from neuraminidase__InfluenzaA__ABW40502

SEQ ID NO: 107707 - RNA, 1413 nt, Artificial Sequence; identical to SEQ ID NO: 107583
  derived and/or modified sequence opt2 from neuraminidase__InfluenzaA__ABW40513

SEQ ID NO: 107708 - RNA, 1413 nt, Artificial Sequence; identical to SEQ ID NO: 107542
  derived and/or modified sequence opt2 from neuraminidase__InfluenzaA__ABW40524

SEQ ID NO: 107709 - RNA, 1413 nt, Artificial Sequence
  derived and/or modified sequence opt2 from neuraminidase__InfluenzaA__ABW40546
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107710 - RNA, 1413 nt, Artificial Sequence; identical to SEQ ID NO: 107542
  derived and/or modified sequence opt2 from neuraminidase__InfluenzaA__ABW40557

SEQ ID NO: 107711 - RNA, 1413 nt, Artificial Sequence
  derived and/or modified sequence opt2 from neuraminidase__InfluenzaA__ABW40568
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107712 - RNA, 1413 nt, Artificial Sequence
  derived and/or modified sequence opt2 from neuraminidase__InfluenzaA__ABW40579
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccaacaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107713 - RNA, 1413 nt, Artificial Sequence
  derived and/or modified sequence opt2 from neuraminidase__InfluenzaA__ABW40601
augaaccccaaccagaagaucaucaccaucggcuccaucuccaucgccaucggcgucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcaucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacggcgacaccgccaacugguccuggcccgacggcgccgagcuccccuucaccaucgacaaguga

SEQ ID NO: 107714 - RNA, 1413 nt, Artificial Sequence; identical to SEQ ID NO: 107577
  derived and/or modified sequence opt2 from neuraminidase__InfluenzaA__ABW40612

SEQ ID NO: 107715 - RNA, 1413 nt, Artificial Sequence; identical to SEQ ID NO: 107542
  derived and/or modified sequence opt2 from neuraminidase__InfluenzaA__ABW40623

SEQ ID NO: 107716 - RNA, 1410 nt, Artificial Sequence; identical to SEQ ID NO: 107396
  derived and/or modified sequence opt2 from neuraminidase__InfluenzaA__ABW40634

SEQ ID NO: 107717 - RNA, 1413 nt, Artificial Sequence; identical to SEQ ID NO: 107542
  derived and/or modified sequence opt2 from neuraminidase__InfluenzaA__ABW40645

SEQ ID NO: 107718 - RNA, 1410 nt, Artificial Sequence
  derived and/or modified sequence opt2 from neuraminidase__InfluenzaA__ABW40656
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcggcaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107719 - RNA, 1413 nt, Artificial Sequence; identical to SEQ ID NO: 107583
  derived and/or modified sequence opt2 from neuraminidase__InfluenzaA__ABW40667

SEQ ID NO: 107720 - RNA, 1413 nt, Artificial Sequence; identical to SEQ ID NO: 107568
  derived and/or modified sequence opt2 from neuraminidase__InfluenzaA__ABW40678

SEQ ID NO: 107721 - RNA, 1413 nt, Artificial Sequence; identical to SEQ ID NO: 107577
  derived and/or modified sequence opt2 from neuraminidase__InfluenzaA__ABW71297

SEQ ID NO: 107722 - RNA, 1413 nt, Artificial Sequence; identical to SEQ ID NO: 107583
  derived and/or modified sequence opt2 from neuraminidase__InfluenzaA__ABW71308

SEQ ID NO: 107723 - RNA, 1413 nt, Artificial Sequence; identical to SEQ ID NO: 107542
  derived and/or modified sequence opt2 from neuraminidase__InfluenzaA__ABW71319

SEQ ID NO: 107724 - RNA, 1413 nt, Artificial Sequence; identical to SEQ ID NO: 107542
  derived and/or modified sequence opt2 from neuraminidase__InfluenzaA__ABW71330

SEQ ID NO: 107725 - RNA, 1413 nt, Artificial Sequence
  derived and/or modified sequence opt2 from neuraminidase__InfluenzaA__ABW71341
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggcucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107726 - RNA, 1410 nt, Artificial Sequence; identical to SEQ ID NO: 107569
  derived and/or modified sequence opt2 from neuraminidase__InfluenzaA__ABW71352

SEQ ID NO: 107727 - RNA, 1413 nt, Artificial Sequence; identical to SEQ ID NO: 107583
  derived and/or modified sequence opt2 from neuraminidase__InfluenzaA__ABW71363

SEQ ID NO: 107728 - RNA, 1413 nt, Artificial Sequence; identical to SEQ ID NO: 107568
  derived and/or modified sequence opt2 from neuraminidase__InfluenzaA__ABW71374

SEQ ID NO: 107729 - RNA, 1413 nt, Artificial Sequence; identical to SEQ ID NO: 107542
  derived and/or modified sequence opt2 from neuraminidase__InfluenzaA__ABW71385

SEQ ID NO: 107730 - RNA, 1413 nt, Artificial Sequence
  derived and/or modified sequence opt2 from neuraminidase__InfluenzaA__ABW71396
augaaccccaaccagaagaucaucaccaucggcuccaucuccaucgccaucggcaucaucucccucaugcuccagaucggcaacaucaucuccaucugggccucccacuccguccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacgccaccaucuggaccuccggcuccuccaucuccuucugcggcgucgacuccgacaccgccaacugguccuggcccgacggcgccgagcuccccuucaccaucgacaaguga

SEQ ID NO: 107731 - RNA, 1413 nt, Artificial Sequence
  derived and/or modified sequence opt2 from neuraminidase__InfluenzaA__ABW71407
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagauccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107732 - RNA, 1413 nt, Artificial Sequence; identical to SEQ ID NO: 107568
  derived and/or modified sequence opt2 from neuraminidase__InfluenzaA__ABW71418

SEQ ID NO: 107733 - RNA, 1413 nt, Artificial Sequence; identical to SEQ ID NO: 107542
  derived and/or modified sequence opt2 from neuraminidase__InfluenzaA__ABW71440

SEQ ID NO: 107734 - RNA, 1413 nt, Artificial Sequence; identical to SEQ ID NO: 107542
  derived and/or modified sequence opt2 from neuraminidase__InfluenzaA__ABW71451

SEQ ID NO: 107735 - RNA, 1413 nt, Artificial Sequence; identical to SEQ ID NO: 107577
  derived and/or modified sequence opt2 from neuraminidase__InfluenzaA__ABW71462

SEQ ID NO: 107736 - RNA, 1410 nt, Artificial Sequence; identical to SEQ ID NO: 105839
  derived and/or modified sequence opt2 from neuraminidase__InfluenzaA__ABW80980

SEQ ID NO: 107737 - RNA, 1410 nt, Artificial Sequence; identical to SEQ ID NO: 105683
  derived and/or modified sequence opt2 from neuraminidase__InfluenzaA__ABW80981

SEQ ID NO: 107738 - RNA, 1413 nt, Artificial Sequence
  derived and/or modified sequence opt2 from neuraminidase__InfluenzaA__ABW81474
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagaagaucaucaccuacgagaaccgcaccugggucaaccagaccuacgucaacuucaacaacaccaacgucgucgccggcaaggacaagcccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 107739 - RNA, 1413 nt, Artificial Sequence
  derived and/or modified sequence opt2 from neuraminidase__InfluenzaA__ABW81475
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaaguccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucucccucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107740 - RNA, 1413 nt, Artificial Sequence
  derived and/or modified sequence opt2 from neuraminidase__InfluenzaA__ABW81477
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucuccgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggcccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 107741 - RNA, 1413 nt, Artificial Sequence
  derived and/or modified sequence opt2 from neuraminidase__InfluenzaA__ABW81478
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaagaacaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107742 - RNA, 1413 nt, Artificial Sequence
  derived and/or modified sequence opt2 from neuraminidase__InfluenzaA__ABW81479
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagaagaucaucaccuacgagaaccgcaccugggucaaccagaccuacgucaacaucaacaacaccaacgucgucgccggcaaggacaagcccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcaucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 107743 - RNA, 1413 nt, Artificial Sequence; identical to SEQ ID NO: 105908
  derived and/or modified sequence opt2 from neuraminidase__InfluenzaA__ABW81480

SEQ ID NO: 107744 - RNA, 1413 nt, Artificial Sequence
  derived and/or modified sequence opt2 from neuraminidase__InfluenzaA__ABW81481
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagaagaucaucaccuacgagaaccgcaccugggucaaccagaccuacgucaacaucaacaacaccaacgucgucgccggcaaggacaagcccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 107745 - RNA, 1413 nt, Artificial Sequence
  derived and/or modified sequence opt2 from neuraminidase__InfluenzaA__ABW81482
augaaccccaaccagaagaucaucaccaucggcuccaucuccgucgccaucggcaucaucucccucauccuccagaucggcaacaucaucuccaucugggccucccacuccauccagaccggcucccagaacuacaccggcaucugcaaccagaagaucaucaccuacgagaaccgcaccugggucaaccagaccuacgucaacaucaacaacaccaacgucgucgccggcaaggacaagcccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuuccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaaccgcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacgucgucgccaugaccgacugguccggcuacuccggcuccuucguccagcaccccgagcucaccggccucgccugcaugcgccccugcuucugggucgagcucguccgcggccucccccgcgagaacaccaccaucuggaccuccggcuccuccaucuccuucugcggcgucaacuccgagaccgccaacugguccuggcccgacggcgccgagcuccccuucaccaucgacaaguga

SEQ ID NO: 107746 - RNA, 1413 nt, Artificial Sequence; identical to SEQ ID NO: 105898
  derived and/or modified sequence opt2 from neuraminidase__InfluenzaA__ABW81483

SEQ ID NO: 107747 - RNA, 1413 nt, Artificial Sequence
  derived and/or modified sequence opt2 from neuraminidase__InfluenzaA__ABW81484
augaaccccaaccagaagaucaucaccaucggcuccaucuccaucgccaucggcaucaucucccucaugcuccagaucggcaacaucaucuccaucugggccucccacuccauccagaccggcaaccagaaccacaccggcaucugcaaccagcgcaucaucaccuacgagaacuccaccugggucaaccacaccuacgucaacaucaacaacaccaacgucgucgccggcaagggcaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107748 - RNA, 1413 nt, Artificial Sequence
  derived and/or modified sequence opt2 from neuraminidase__InfluenzaA__ABW81487
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucauccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107749 - RNA, 1413 nt, Artificial Sequence; identical to SEQ ID NO: 105898
  derived and/or modified sequence opt2 from neuraminidase__InfluenzaA__ABW81488

SEQ ID NO: 107750 - RNA, 1413 nt, Artificial Sequence; identical to SEQ ID NO: 105898
  derived and/or modified sequence opt2 from neuraminidase__InfluenzaA__ABW81489

SEQ ID NO: 107751 - RNA, 1413 nt, Artificial Sequence
  derived and/or modified sequence opt2 from neuraminidase__InfluenzaA__ABW81490
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107752 - RNA, 1413 nt, Artificial Sequence
  derived and/or modified sequence opt2 from neuraminidase__InfluenzaA__ABW81491
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccugggagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107753 - RNA, 1413 nt, Artificial Sequence
  derived and/or modified sequence opt2 from neuraminidase__InfluenzaA__ABW81492
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucugggccuccggcuccuccaucuccuucugcggcgucgacuccgacaccgccaacugguccuggcccgacggcgccgagcuccccuucaccaucgacaaguga

SEQ ID NO: 107754 - RNA, 1413 nt, Artificial Sequence; identical to SEQ ID NO: 105898
  derived and/or modified sequence opt2 from neuraminidase__InfluenzaA__ABW81493

SEQ ID NO: 107755 - RNA, 1413 nt, Artificial Sequence; identical to SEQ ID NO: 105898
  derived and/or modified sequence opt2 from neuraminidase__InfluenzaA__ABW81494

SEQ ID NO: 107756 - RNA, 1413 nt, Artificial Sequence; identical to SEQ ID NO: 105898
  derived and/or modified sequence opt2 from neuraminidase__InfluenzaA__ABW81495

SEQ ID NO: 107757 - RNA, 1413 nt, Artificial Sequence; identical to SEQ ID NO: 107752
  derived and/or modified sequence opt2 from neuraminidase__InfluenzaA__ABW81497

SEQ ID NO: 107758 - RNA, 1413 nt, Artificial Sequence
  derived and/or modified sequence opt2 from neuraminidase__InfluenzaA__ABW81498
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccugggagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107759 - RNA, 1413 nt, Artificial Sequence
  derived and/or modified sequence opt2 from neuraminidase__InfluenzaA__ABW81499
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggccgcgacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107760 - RNA, 1413 nt, Artificial Sequence
  derived and/or modified sequence opt2 from neuraminidase__InfluenzaA__ABW81500
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgccgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107761 - RNA, 1413 nt, Artificial Sequence
  derived and/or modified sequence opt2 from neuraminidase__InfluenzaA__ABW81501
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagaagaucaucaccuacgagaacuccaccugggucaaccacaccuacgucaacaucaacaacaccaacgucgucgccggcaaggacaagaccuccgucacccucgccggcaacuccucccucugcuccgucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107762 - RNA, 1413 nt, Artificial Sequence; identical to SEQ ID NO: 107583
  derived and/or modified sequence opt2 from neuraminidase__InfluenzaA__ABW86324

SEQ ID NO: 107763 - RNA, 1413 nt, Artificial Sequence; identical to SEQ ID NO: 107555
  derived and/or modified sequence opt2 from neuraminidase__InfluenzaA__ABW86335

SEQ ID NO: 107764 - RNA, 1413 nt, Artificial Sequence; identical to SEQ ID NO: 107542
  derived and/or modified sequence opt2 from neuraminidase__InfluenzaA__ABW86346

SEQ ID NO: 107765 - RNA, 1413 nt, Artificial Sequence; identical to SEQ ID NO: 107542
  derived and/or modified sequence opt2 from neuraminidase__InfluenzaA__ABW86357

SEQ ID NO: 107766 - RNA, 1413 nt, Artificial Sequence; identical to SEQ ID NO: 107542
  derived and/or modified sequence opt2 from neuraminidase__InfluenzaA__ABW86368

SEQ ID NO: 107767 - RNA, 1413 nt, Artificial Sequence; identical to SEQ ID NO: 107568
  derived and/or modified sequence opt2 from neuraminidase__InfluenzaA__ABW86379

SEQ ID NO: 107768 - RNA, 1413 nt, Artificial Sequence; identical to SEQ ID NO: 107542
  derived and/or modified sequence opt2 from neuraminidase__InfluenzaA__ABW86390

SEQ ID NO: 107769 - RNA, 1413 nt, Artificial Sequence; identical to SEQ ID NO: 107583
  derived and/or modified sequence opt2 from neuraminidase__InfluenzaA__ABW86401

SEQ ID NO: 107770 - RNA, 1413 nt, Artificial Sequence; identical to SEQ ID NO: 107542
  derived and/or modified sequence opt2 from neuraminidase__InfluenzaA__ABW86412

SEQ ID NO: 107771 - RNA, 1413 nt, Artificial Sequence
  derived and/or modified sequence opt2 from neuraminidase__InfluenzaA__ABW86423
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucgccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107772 - RNA, 1413 nt, Artificial Sequence; identical to SEQ ID NO: 107542
  derived and/or modified sequence opt2 from neuraminidase__InfluenzaA__ABW86434

SEQ ID NO: 107773 - RNA, 1413 nt, Artificial Sequence; identical to SEQ ID NO: 107542
  derived and/or modified sequence opt2 from neuraminidase__InfluenzaA__ABW86445

SEQ ID NO: 107774 - RNA, 1413 nt, Artificial Sequence; identical to SEQ ID NO: 107577
  derived and/or modified sequence opt2 from neuraminidase__InfluenzaA__ABW86456

SEQ ID NO: 107775 - RNA, 1413 nt, Artificial Sequence
  derived and/or modified sequence opt2 from neuraminidase__InfluenzaA__ABW86467
augaacaccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccaucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107776 - RNA, 1413 nt, Artificial Sequence; identical to SEQ ID NO: 107577
  derived and/or modified sequence opt2 from neuraminidase__InfluenzaA__ABW86478

SEQ ID NO: 107777 - RNA, 1413 nt, Artificial Sequence
  derived and/or modified sequence opt2 from neuraminidase__InfluenzaA__ABW86489
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucggcaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107778 - RNA, 1413 nt, Artificial Sequence
  derived and/or modified sequence opt2 from neuraminidase__InfluenzaA__ABW86500
augaaccccaaccagaagaucaugaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccaugaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107779 - RNA, 1413 nt, Artificial Sequence; identical to SEQ ID NO: 107542
  derived and/or modified sequence opt2 from neuraminidase__InfluenzaA__ABW86511

SEQ ID NO: 107780 - RNA, 1413 nt, Artificial Sequence
  derived and/or modified sequence opt2 from neuraminidase__InfluenzaA__ABW86522
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccgucaccgacugguccggcuacuccggcuccuucguccagcaccccgagcucaccggccucgacugcauccgccccugcuucugggucgagcucguccgcggccucccccgcgagaacgccaccaucuggaccuccggcuccuccaucuccuucugcggcgucgacuccgacaccgccaacugguccuggcccgacggcgccgagcuccccuucaccaucgacaaguga

SEQ ID NO: 107781 - RNA, 1413 nt, Artificial Sequence; identical to SEQ ID NO: 107542
  derived and/or modified sequence opt2 from neuraminidase__InfluenzaA__ABW86533

SEQ ID NO: 107782 - RNA, 1413 nt, Artificial Sequence; identical to SEQ ID NO: 107577
  derived and/or modified sequence opt2 from neuraminidase__InfluenzaA__ABW86544

SEQ ID NO: 107783 - RNA, 1413 nt, Artificial Sequence; identical to SEQ ID NO: 107542
  derived and/or modified sequence opt2 from neuraminidase__InfluenzaA__ABW86555

SEQ ID NO: 107784 - RNA, 1410 nt, Artificial Sequence
  derived and/or modified sequence opt2 from neuraminidase__InfluenzaA__ABW86566
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccgucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107785 - RNA, 1413 nt, Artificial Sequence; identical to SEQ ID NO: 107568
  derived and/or modified sequence opt2 from neuraminidase__InfluenzaA__ABW86609

SEQ ID NO: 107786 - RNA, 1413 nt, Artificial Sequence; identical to SEQ ID NO: 106571
  derived and/or modified sequence opt2 from neuraminidase__InfluenzaA__ABW91188

SEQ ID NO: 107787 - RNA, 1410 nt, Artificial Sequence
  derived and/or modified sequence opt2 from neuraminidase__InfluenzaA__ABW91210
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucauccucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107788 - RNA, 1413 nt, Artificial Sequence; identical to SEQ ID NO: 107542
  derived and/or modified sequence opt2 from neuraminidase__InfluenzaA__ABW91221

SEQ ID NO: 107789 - RNA, 1410 nt, Artificial Sequence
  derived and/or modified sequence opt2 from neuraminidase__InfluenzaA__ABW91232
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgaguccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107790 - RNA, 1410 nt, Artificial Sequence; identical to SEQ ID NO: 107578
  derived and/or modified sequence opt2 from neuraminidase__InfluenzaA__ABW91243

SEQ ID NO: 107791 - RNA, 1410 nt, Artificial Sequence; identical to SEQ ID NO: 107396
  derived and/or modified sequence opt2 from neuraminidase__InfluenzaA__ABW91254

SEQ ID NO: 107792 - RNA, 1410 nt, Artificial Sequence; identical to SEQ ID NO: 107396
  derived and/or modified sequence opt2 from neuraminidase__InfluenzaA__ABW91265

SEQ ID NO: 107793 - RNA, 1413 nt, Artificial Sequence; identical to SEQ ID NO: 107542
  derived and/or modified sequence opt2 from neuraminidase__InfluenzaA__ABW91276

SEQ ID NO: 107794 - RNA, 1413 nt, Artificial Sequence
  derived and/or modified sequence opt2 from neuraminidase__InfluenzaA__ABW91287
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacaucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 107795 - RNA, 1413 nt, Artificial Sequence; identical to SEQ ID NO: 107542
  derived and/or modified sequence opt2 from neuraminidase__InfluenzaA__ABW91298

SEQ ID NO: 107796 - RNA, 1413 nt, Artificial Sequence
  derived and/or modified sequence opt2 from neuraminidase__InfluenzaA__ABW91309
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccgacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgccgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107797 - RNA, 1413 nt, Artificial Sequence; identical to SEQ ID NO: 107542
  derived and/or modified sequence opt2 from neuraminidase__InfluenzaA__ABW91320

SEQ ID NO: 107798 - RNA, 1413 nt, Artificial Sequence; identical to SEQ ID NO: 107542
  derived and/or modified sequence opt2 from neuraminidase__InfluenzaA__ABW91331

SEQ ID NO: 107799 - RNA, 1413 nt, Artificial Sequence; identical to SEQ ID NO: 107542
  derived and/or modified sequence opt2 from neuraminidase__InfluenzaA__ABW91342

SEQ ID NO: 107800 - RNA, 1413 nt, Artificial Sequence; identical to SEQ ID NO: 107542
  derived and/or modified sequence opt2 from neuraminidase__InfluenzaA__ABW91353

SEQ ID NO: 107801 - RNA, 1413 nt, Artificial Sequence
  derived and/or modified sequence opt2 from neuraminidase__InfluenzaA__ABW91364
augaacaccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucaccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccgacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacaacgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107802 - RNA, 1413 nt, Artificial Sequence; identical to SEQ ID NO: 107542
  derived and/or modified sequence opt2 from neuraminidase__InfluenzaA__ABW91375

SEQ ID NO: 107803 - RNA, 1413 nt, Artificial Sequence; identical to SEQ ID NO: 107568
  derived and/or modified sequence opt2 from neuraminidase__InfluenzaA__ABW91386

SEQ ID NO: 107804 - RNA, 1410 nt, Artificial Sequence
  derived and/or modified sequence opt2 from neuraminidase__InfluenzaA__ABW91397
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcaucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107805 - RNA, 1413 nt, Artificial Sequence; identical to SEQ ID NO: 107713
  derived and/or modified sequence opt2 from neuraminidase__InfluenzaA__ABW91408

SEQ ID NO: 107806 - RNA, 1413 nt, Artificial Sequence
  derived and/or modified sequence opt2 from neuraminidase__InfluenzaA__ABW91419
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107807 - RNA, 1413 nt, Artificial Sequence
  derived and/or modified sequence opt2 from neuraminidase__InfluenzaA__ABW91430
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcuccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107808 - RNA, 1410 nt, Artificial Sequence; identical to SEQ ID NO: 107396
  derived and/or modified sequence opt2 from neuraminidase__InfluenzaA__ABW91441

SEQ ID NO: 107809 - RNA, 1413 nt, Artificial Sequence; identical to SEQ ID NO: 107583
  derived and/or modified sequence opt2 from neuraminidase__InfluenzaA__ABW91452

SEQ ID NO: 107810 - RNA, 1413 nt, Artificial Sequence; identical to SEQ ID NO: 107583
  derived and/or modified sequence opt2 from neuraminidase__InfluenzaA__ABW91463

SEQ ID NO: 107811 - RNA, 1413 nt, Artificial Sequence; identical to SEQ ID NO: 107542
  derived and/or modified sequence opt2 from neuraminidase__InfluenzaA__ABW91474

SEQ ID NO: 107812 - RNA, 1413 nt, Artificial Sequence; identical to SEQ ID NO: 107583
  derived and/or modified sequence opt2 from neuraminidase__InfluenzaA__ABW91485

SEQ ID NO: 107813 - RNA, 1413 nt, Artificial Sequence; identical to SEQ ID NO: 107542
  derived and/or modified sequence opt2 from neuraminidase__InfluenzaA__ABW91496

SEQ ID NO: 107814 - RNA, 1413 nt, Artificial Sequence; identical to SEQ ID NO: 107568
  derived and/or modified sequence opt2 from neuraminidase__InfluenzaA__ABW91507

SEQ ID NO: 107815 - RNA, 1413 nt, Artificial Sequence; identical to SEQ ID NO: 107583
  derived and/or modified sequence opt2 from neuraminidase__InfluenzaA__ABW91518

SEQ ID NO: 107816 - RNA, 1413 nt, Artificial Sequence
  derived and/or modified sequence opt2 from neuraminidase__InfluenzaA__ABW91529
augaaccccaaccagaagaucaucaccaucggcuccaucuccaucgccaucggcaccaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107817 - RNA, 1413 nt, Artificial Sequence
  derived and/or modified sequence opt2 from neuraminidase__InfluenzaA__ABW91540
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccuggaugaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107818 - RNA, 1410 nt, Artificial Sequence
  derived and/or modified sequence opt2 from neuraminidase__InfluenzaA__ABW91551
augaaccccaaccagaagaucaucaccaucggcuccgucucccucaccaucuccaccaucugcuucuucaugcagaucgccauccucaucaccaccgucacccuccacuucaagcaguacgaguucaacuucccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107819 - RNA, 1413 nt, Artificial Sequence; identical to SEQ ID NO: 107542
  derived and/or modified sequence opt2 from neuraminidase__InfluenzaA__ABW91562

SEQ ID NO: 107820 - RNA, 1413 nt, Artificial Sequence; identical to SEQ ID NO: 107577
  derived and/or modified sequence opt2 from neuraminidase__InfluenzaA__ABW91584

SEQ ID NO: 107821 - RNA, 1413 nt, Artificial Sequence; identical to SEQ ID NO: 107542
  derived and/or modified sequence opt2 from neuraminidase__InfluenzaA__ABW91595

SEQ ID NO: 107822 - RNA, 1413 nt, Artificial Sequence; identical to SEQ ID NO: 107583
  derived and/or modified sequence opt2 from neuraminidase__InfluenzaA__ABW91606

SEQ ID NO: 107823 - RNA, 1413 nt, Artificial Sequence; identical to SEQ ID NO: 107577
  derived and/or modified sequence opt2 from neuraminidase__InfluenzaA__ABW91617

SEQ ID NO: 107824 - RNA, 1413 nt, Artificial Sequence; identical to SEQ ID NO: 107542
  derived and/or modified sequence opt2 from neuraminidase__InfluenzaA__ABW91628

SEQ ID NO: 107825 - RNA, 1413 nt, Artificial Sequence; identical to SEQ ID NO: 107542
  derived and/or modified sequence opt2 from neuraminidase__InfluenzaA__ABW91639

SEQ ID NO: 107826 - RNA, 1410 nt, Artificial Sequence; identical to SEQ ID NO: 107396
  derived and/or modified sequence opt2 from neuraminidase__InfluenzaA__ABW91650

SEQ ID NO: 107827 - RNA, 1350 nt, Artificial Sequence
  derived and/or modified sequence opt2 from neuraminidase__InfluenzaA__ABX10517
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaacuuccucaccgagaaggccgucgccuccgucaagcucgccggcaacuccucccucugccccaucaacggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucugggccuccggcuccuccaucuccuucugcggcgucaacuccgacaccgucggcugguccuggcccgacggcgccgagcuccccuucaccaucgacaaguga

SEQ ID NO: 107828 - RNA, 1410 nt, Artificial Sequence; identical to SEQ ID NO: 107441
  derived and/or modified sequence opt2 from neuraminidase__InfluenzaA__ABX10527

SEQ ID NO: 107829 - RNA, 1413 nt, Artificial Sequence
  derived and/or modified sequence opt2 from neuraminidase__InfluenzaA__ABX58242
augaaccccaaccagaagaucaucaccaucggcuccaucuccaucgccaucggcaucaucucccucaugcuccagaucggcaacaucaucuccaucuggaccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107830 - RNA, 1413 nt, Artificial Sequence; identical to SEQ ID NO: 107641
  derived and/or modified sequence opt2 from neuraminidase__InfluenzaA__ABX58253

SEQ ID NO: 107831 - RNA, 1413 nt, Artificial Sequence; identical to SEQ ID NO: 107542
  derived and/or modified sequence opt2 from neuraminidase__InfluenzaA__ABX58264

SEQ ID NO: 107832 - RNA, 1413 nt, Artificial Sequence; identical to SEQ ID NO: 107542
  derived and/or modified sequence opt2 from neuraminidase__InfluenzaA__ABX58275

SEQ ID NO: 107833 - RNA, 1413 nt, Artificial Sequence; identical to SEQ ID NO: 107542
  derived and/or modified sequence opt2 from neuraminidase__InfluenzaA__ABX58286

SEQ ID NO: 107834 - RNA, 1413 nt, Artificial Sequence
  derived and/or modified sequence opt2 from neuraminidase__InfluenzaA__ABX58297
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagaagaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107835 - RNA, 1413 nt, Artificial Sequence; identical to SEQ ID NO: 107713
  derived and/or modified sequence opt2 from neuraminidase__InfluenzaA__ABX58308

SEQ ID NO: 107836 - RNA, 1413 nt, Artificial Sequence
  derived and/or modified sequence opt2 from neuraminidase__InfluenzaA__ABX58319
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107837 - RNA, 1413 nt, Artificial Sequence; identical to SEQ ID NO: 107713
  derived and/or modified sequence opt2 from neuraminidase__InfluenzaA__ABX58352

SEQ ID NO: 107838 - RNA, 1413 nt, Artificial Sequence; identical to SEQ ID NO: 107542
  derived and/or modified sequence opt2 from neuraminidase__InfluenzaA__ABX58363

SEQ ID NO: 107839 - RNA, 1413 nt, Artificial Sequence; identical to SEQ ID NO: 107542
  derived and/or modified sequence opt2 from neuraminidase__InfluenzaA__ABX58385

SEQ ID NO: 107840 - RNA, 1413 nt, Artificial Sequence; identical to SEQ ID NO: 107542
  derived and/or modified sequence opt2 from neuraminidase__InfluenzaA__ABX58396

SEQ ID NO: 107841 - RNA, 1413 nt, Artificial Sequence
  derived and/or modified sequence opt2 from neuraminidase__InfluenzaA__ABX58407
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugccccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107842 - RNA, 1413 nt, Artificial Sequence; identical to SEQ ID NO: 107583
  derived and/or modified sequence opt2 from neuraminidase__InfluenzaA__ABX58418

SEQ ID NO: 107843 - RNA, 1413 nt, Artificial Sequence; identical to SEQ ID NO: 107542
  derived and/or modified sequence opt2 from neuraminidase__InfluenzaA__ABX58429

SEQ ID NO: 107844 - RNA, 1413 nt, Artificial Sequence; identical to SEQ ID NO: 107542
  derived and/or modified sequence opt2 from neuraminidase__InfluenzaA__ABX58440

SEQ ID NO: 107845 - RNA, 1413 nt, Artificial Sequence
  derived and/or modified sequence opt2 from neuraminidase__InfluenzaA__ABX58451
augaaccccaaccagaagaucaucaccaucggcuccaucuccaucgccaucggcaccaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107846 - RNA, 1413 nt, Artificial Sequence; identical to SEQ ID NO: 107583
  derived and/or modified sequence opt2 from neuraminidase__InfluenzaA__ABX58462

SEQ ID NO: 107847 - RNA, 1413 nt, Artificial Sequence; identical to SEQ ID NO: 107542
  derived and/or modified sequence opt2 from neuraminidase__InfluenzaA__ABX58473

SEQ ID NO: 107848 - RNA, 1413 nt, Artificial Sequence; identical to SEQ ID NO: 107583
  derived and/or modified sequence opt2 from neuraminidase__InfluenzaA__ABX58484

SEQ ID NO: 107849 - RNA, 1413 nt, Artificial Sequence
  derived and/or modified sequence opt2 from neuraminidase__InfluenzaA__ABX58495
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaaccgcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107850 - RNA, 1413 nt, Artificial Sequence; identical to SEQ ID NO: 107577
  derived and/or modified sequence opt2 from neuraminidase__InfluenzaA__ABX58506

SEQ ID NO: 107851 - RNA, 1413 nt, Artificial Sequence; identical to SEQ ID NO: 107583
  derived and/or modified sequence opt2 from neuraminidase__InfluenzaA__ABX58528

SEQ ID NO: 107852 - RNA, 1413 nt, Artificial Sequence; identical to SEQ ID NO: 107583
  derived and/or modified sequence opt2 from neuraminidase__InfluenzaA__ABX58539

SEQ ID NO: 107853 - RNA, 1413 nt, Artificial Sequence
  derived and/or modified sequence opt2 from neuraminidase__InfluenzaA__ABX58550
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccgucgacaaguga

SEQ ID NO: 107854 - RNA, 1413 nt, Artificial Sequence; identical to SEQ ID NO: 107542
  derived and/or modified sequence opt2 from neuraminidase__InfluenzaA__ABX58561

SEQ ID NO: 107855 - RNA, 1413 nt, Artificial Sequence
  derived and/or modified sequence opt2 from neuraminidase__InfluenzaA__ABX58572
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107856 - RNA, 1413 nt, Artificial Sequence; identical to SEQ ID NO: 107542
  derived and/or modified sequence opt2 from neuraminidase__InfluenzaA__ABX58583

SEQ ID NO: 107857 - RNA, 1413 nt, Artificial Sequence; identical to SEQ ID NO: 107542
  derived and/or modified sequence opt2 from neuraminidase__InfluenzaA__ABX58594

SEQ ID NO: 107858 - RNA, 1413 nt, Artificial Sequence; identical to SEQ ID NO: 107568
  derived and/or modified sequence opt2 from neuraminidase__InfluenzaA__ABX58605

SEQ ID NO: 107859 - RNA, 1413 nt, Artificial Sequence; identical to SEQ ID NO: 107568
  derived and/or modified sequence opt2 from neuraminidase__InfluenzaA__ABX58616

SEQ ID NO: 107860 - RNA, 1413 nt, Artificial Sequence; identical to SEQ ID NO: 107542
  derived and/or modified sequence opt2 from neuraminidase__InfluenzaA__ABX58627

SEQ ID NO: 107861 - RNA, 1413 nt, Artificial Sequence; identical to SEQ ID NO: 107542
  derived and/or modified sequence opt2 from neuraminidase__InfluenzaA__ABX58638

SEQ ID NO: 107862 - RNA, 1413 nt, Artificial Sequence
  derived and/or modified sequence opt2 from neuraminidase__InfluenzaA__ABX58682
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccaugaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107863 - RNA, 1413 nt, Artificial Sequence
  derived and/or modified sequence opt2 from neuraminidase__InfluenzaA__ABX58693
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaaccgcgccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcguccucggcgacaacccccgccccgaggacggcgagggcuccugcaaccccgucaccgucgacggcgccgacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107864 - RNA, 1413 nt, Artificial Sequence; identical to SEQ ID NO: 107713
  derived and/or modified sequence opt2 from neuraminidase__InfluenzaA__ABX58704

SEQ ID NO: 107865 - RNA, 1413 nt, Artificial Sequence; identical to SEQ ID NO: 107641
  derived and/or modified sequence opt2 from neuraminidase__InfluenzaA__ABX58715

SEQ ID NO: 107866 - RNA, 1350 nt, Artificial Sequence
  derived and/or modified sequence opt2 from neuraminidase__InfluenzaA__ABY19420
augaaccccaaccagaaggucaucaccaucggcuccaucugcauggucaucggcaucgucucccucaugcuccagaucggcaacaugaucuccaucugggucucccacuccauccagaccggcaaccagaaccaggucgagcccaucaucaacaccaacuuccucaccggcaaggccgucgccuccaucacccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccacaacggcgccuacggcgucaagggcuucuccuucaaguacggcaacggcgucuggaucggccgcaccaagucccccaacucccgcuccggcuucgagaugaucugggaccccaacggcugguccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucaacuccgacaccgucuccugguccuggcccgacggcgccgagcuccccuucuccaucgacaaguga

SEQ ID NO: 107867 - RNA, 1350 nt, Artificial Sequence
  derived and/or modified sequence opt2 from neuraminidase__InfluenzaA__ABY19421
augaaccccaaccagaagaucaucaccaucggcuccaucugcauggucaucggcaucgucucccucaugcuccagaucggcaacaugaucuccaucugggucucccacuccauccagaccggcaaccagaaccaggucgagcccaucaucaacaccaacuuccucaccggcaaggccgucgccuccaucacccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccacaacggcgccuacggcgucaagggcuucuccuucaaguacggcaacggcgucuggaucggccgcaccaagucccccaacucccgcuccggcuucgagaugaucugggaccccaacggcugguccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucaacuccgacaccgucuccugguccuggcccgacggcgccgagcuccccuucuccaucgacaaguga

SEQ ID NO: 107868 - RNA, 1413 nt, Artificial Sequence
  derived and/or modified sequence opt2 from neuraminidase__InfluenzaA__ABY51020
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaacccccucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107869 - RNA, 1410 nt, Artificial Sequence; identical to SEQ ID NO: 107578
  derived and/or modified sequence opt2 from neuraminidase__InfluenzaA__ABY51031

SEQ ID NO: 107870 - RNA, 1413 nt, Artificial Sequence
  derived and/or modified sequence opt2 from neuraminidase__InfluenzaA__ABY51042
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaaccgcgccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107871 - RNA, 1413 nt, Artificial Sequence
  derived and/or modified sequence opt2 from neuraminidase__InfluenzaA__ABY51053
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaaccgcgccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcaccgacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107872 - RNA, 1413 nt, Artificial Sequence; identical to SEQ ID NO: 107641
  derived and/or modified sequence opt2 from neuraminidase__InfluenzaA__ABY51064

SEQ ID NO: 107873 - RNA, 1413 nt, Artificial Sequence; identical to SEQ ID NO: 107542
  derived and/or modified sequence opt2 from neuraminidase__InfluenzaA__ABY51075

SEQ ID NO: 107874 - RNA, 1413 nt, Artificial Sequence
  derived and/or modified sequence opt2 from neuraminidase__InfluenzaA__ABY51086
augaaccccaaccagaagaucaucaccaucggcuccaucuccaucgccaucggcaucaucuccaucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcaucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacggcgacaccgccaacugguccuggcccgacggcgccgagcuccccuucaccaucgacaaguga

SEQ ID NO: 107875 - RNA, 1413 nt, Artificial Sequence
  derived and/or modified sequence opt2 from neuraminidase__InfluenzaA__ABY51097
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107876 - RNA, 1413 nt, Artificial Sequence
  derived and/or modified sequence opt2 from neuraminidase__InfluenzaA__ABY51108
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107877 - RNA, 1413 nt, Artificial Sequence; identical to SEQ ID NO: 107542
  derived and/or modified sequence opt2 from neuraminidase__InfluenzaA__ABY51119

SEQ ID NO: 107878 - RNA, 1410 nt, Artificial Sequence; identical to SEQ ID NO: 107396
  derived and/or modified sequence opt2 from neuraminidase__InfluenzaA__ABY51130

SEQ ID NO: 107879 - RNA, 1413 nt, Artificial Sequence; identical to SEQ ID NO: 107583
  derived and/or modified sequence opt2 from neuraminidase__InfluenzaA__ABY51141

SEQ ID NO: 107880 - RNA, 1413 nt, Artificial Sequence
  derived and/or modified sequence opt2 from neuraminidase__InfluenzaA__ABY51152
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107881 - RNA, 1413 nt, Artificial Sequence
  derived and/or modified sequence opt2 from neuraminidase__InfluenzaA__ABY51163
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucauccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107882 - RNA, 1413 nt, Artificial Sequence
  derived and/or modified sequence opt2 from neuraminidase__InfluenzaA__ABY51174
augaaccccaaccagaagaugaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccaggucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaacaagcuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107883 - RNA, 1413 nt, Artificial Sequence; identical to SEQ ID NO: 107542
  derived and/or modified sequence opt2 from neuraminidase__InfluenzaA__ABY51185

SEQ ID NO: 107884 - RNA, 1413 nt, Artificial Sequence; identical to SEQ ID NO: 107577
  derived and/or modified sequence opt2 from neuraminidase__InfluenzaA__ABY51196

SEQ ID NO: 107885 - RNA, 1410 nt, Artificial Sequence; identical to SEQ ID NO: 107578
  derived and/or modified sequence opt2 from neuraminidase__InfluenzaA__ABY51229

SEQ ID NO: 107886 - RNA, 1413 nt, Artificial Sequence
  derived and/or modified sequence opt2 from neuraminidase__InfluenzaA__ABY51240
augaaccccaaccagaagaucaucaccaucggcuccaucuccaucgccaucggcaucaucucccucaugcuccagaucggcaacaucaucuccgucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugguccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107887 - RNA, 1413 nt, Artificial Sequence; identical to SEQ ID NO: 107568
  derived and/or modified sequence opt2 from neuraminidase__InfluenzaA__ABY51251

SEQ ID NO: 107888 - RNA, 1413 nt, Artificial Sequence
  derived and/or modified sequence opt2 from neuraminidase__InfluenzaA__ABY51262
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacgccaccaucuggaccuccggcuccuccaucuccuucugcggcgucgacuccgacaccgccaacugguccuggcccgacggcgccgagcuccccuucaccaucgacaaguga

SEQ ID NO: 107889 - RNA, 1410 nt, Artificial Sequence; identical to SEQ ID NO: 107396
  derived and/or modified sequence opt2 from neuraminidase__InfluenzaA__ABY51273

SEQ ID NO: 107890 - RNA, 1350 nt, Artificial Sequence
  derived and/or modified sequence opt2 from neuraminidase__InfluenzaA__ABY76285
augaaccccaaccagaagaucaucaccaucggcuccaucugcauggucaucggcaucgucucccucaugcuccagaucggcaacaugaucuccaucugggucucccacuccauccagaccggcaaccagcgccaggccgagcccaucuccaacaccaaguuccucaccgagaaggccgucgccuccgucacccucgccggcaacuccucccucugccccaucuccggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 107891 - RNA, 1413 nt, Artificial Sequence
  derived and/or modified sequence opt2 from neuraminidase__InfluenzaA__ABY81352
augaaccccaaccagaagaucaucaccaucggcuccaucugcauggccaucggcaucaucucccucauccuccagaucggcuccaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccaggccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcuccccuucaccaucgacaaguga

SEQ ID NO: 107892 - RNA, 1413 nt, Artificial Sequence
  derived and/or modified sequence opt2 from neuraminidase__InfluenzaA__ABY81363
augaaccccaaccagaagaucaucaccaucggcuccaucuccaucgccaucggcaucaucucccucaugcuccagaucggcaacaucaucuccaucugggccucccacuccauccagaucggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107893 - RNA, 1410 nt, Artificial Sequence; identical to SEQ ID NO: 107578
  derived and/or modified sequence opt2 from neuraminidase__InfluenzaA__ABY81374

SEQ ID NO: 107894 - RNA, 1413 nt, Artificial Sequence; identical to SEQ ID NO: 107542
  derived and/or modified sequence opt2 from neuraminidase__InfluenzaA__ABY81385

SEQ ID NO: 107895 - RNA, 1413 nt, Artificial Sequence
  derived and/or modified sequence opt2 from neuraminidase__InfluenzaA__ABY81407
augaaccccaaccagaagaucaucaccaucggcuccaucuccaucgccaucggcaccaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuuccucgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107896 - RNA, 1410 nt, Artificial Sequence; identical to SEQ ID NO: 107578
  derived and/or modified sequence opt2 from neuraminidase__InfluenzaA__ACA24505

SEQ ID NO: 107897 - RNA, 1413 nt, Artificial Sequence; identical to SEQ ID NO: 107542
  derived and/or modified sequence opt2 from neuraminidase__InfluenzaA__ACA24516

SEQ ID NO: 107898 - RNA, 1413 nt, Artificial Sequence; identical to SEQ ID NO: 107542
  derived and/or modified sequence opt2 from neuraminidase__InfluenzaA__ACA24527

SEQ ID NO: 107899 - RNA, 1410 nt, Artificial Sequence
  derived and/or modified sequence opt2 from neuraminidase__InfluenzaA__ACA24692
augaaccccaaccagaagaucaucaccaucggcuccgucucccucaccaucuccaccaucugcuucuucaugcagaucgccauccucaucaccaccgucacccuccacuucaagcaguacgaguucucccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccaaguacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaacgaggagaccgagguccucuggaccuccaacuccaucgucgucuucugcggcaccuccggcaccuacggcaccggcuccuggcccgacggcgccgacaucaaccucaugcccaucuga

SEQ ID NO: 107900 - RNA, 1410 nt, Artificial Sequence
  derived and/or modified sequence opt2 from neuraminidase__InfluenzaA__ACA24703
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaucaccaucgagaaggagaccugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaacgccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107901 - RNA, 1413 nt, Artificial Sequence
  derived and/or modified sequence opt2 from neuraminidase__InfluenzaA__ACA33539
augaaccccuaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuucuacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107902 - RNA, 1413 nt, Artificial Sequence
  derived and/or modified sequence opt2 from neuraminidase__InfluenzaA__ACA33540
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuucuacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107903 - RNA, 1413 nt, Artificial Sequence
  derived and/or modified sequence opt2 from neuraminidase__InfluenzaA__ACA33582
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuucuacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107904 - RNA, 1413 nt, Artificial Sequence
  derived and/or modified sequence opt2 from neuraminidase__InfluenzaA__ACA33622
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuucuacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107905 - RNA, 1413 nt, Artificial Sequence; identical to SEQ ID NO: 107581
  derived and/or modified sequence opt2 from neuraminidase__InfluenzaA__ACA96522

SEQ ID NO: 107906 - RNA, 1362 nt, Artificial Sequence
  derived and/or modified sequence opt2 from neuraminidase__InfluenzaA__ACC55274
augaaccccaaccagaagaucaucaccaucggcuccgucucccucaccaucgccaccgucugcuuccucaugcagaucgccauccucgccaugaccgucacccuccacuuccgccagaacgagugcuccaucuccgccaacucccaggucguccccugcgagcccaccaccgagaaggaggucugcuccaaggucgucgacuaccgcuccugguccaagccccagugccagaucaccggcuucgcccccuucuccaaggacaacuccauccgccucuccgccggcggcgacaucuggaucacccgcgagcccuacgucuccugcgacaccuccaagugcuaccaguucgcccucggccagggcaccacccucgacaacgagcacuccaacggcaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgaccgcaacgccaccgccuccuucaucuacaacggcaugcucgucgacuccaucggcuccuggucccagaacauccuccgcacccaggaguccgagugcgucugcaucaacggcuccugcaccgucgucaugaccgacggcuccgccuccggcaaggccgacacccgcauccucuucgucaaggagggcaagaucguccacaucuccccccucuccggcuccgcccagcacaucgaggagugcuccugcuacccccgcuaccccaacguccgcugcgucugccgcgacaacuggaagggcuccaaccgccccgucaucgacaucaacaugaccgacuacuccaucgacuccuccuacgucugcuccggccucgucggcgacaccccccgcaacgaggacuccuccuccuccuccaacugccgcgaccccaacgaggagcgcggcaaccccggcgucaagggcugggccuucgacuccggcgacgacgucuggaugggccgcaccaucucccgcgacucccgcuccggcuacgagaccuuccgcgucaucggcggcuggaccaccgccaacuccaagucccagaccaaccgccaggucaucgucgacaacaacaacugguccggcuacuccggcaucuucuccgucgagcacaaguccugcaucaaccgcugcuucuacgucgagcucauccgcggccgccccaaggagacccgcgucugguggaccuccaacuccaucgucgucuucugcggcaccuccggcaccuacggcaccggcuccuggcccgacggcgccaacaucaacuucaugcccaucuga

SEQ ID NO: 107907 - RNA, 1413 nt, Artificial Sequence; identical to SEQ ID NO: 107841
  derived and/or modified sequence opt2 from neuraminidase__InfluenzaA__ACC61967

SEQ ID NO: 107908 - RNA, 1413 nt, Artificial Sequence
  derived and/or modified sequence opt2 from neuraminidase__InfluenzaA__ACD11077
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggucaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacaacucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcucccccucaccaucgacaaguga

SEQ ID NO: 107909 - RNA, 1413 nt, Artificial Sequence
  derived and/or modified sequence opt2 from neuraminidase__InfluenzaA__ACD11078
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcucccccucaccaucgacaaguga

SEQ ID NO: 107910 - RNA, 1413 nt, Artificial Sequence
  derived and/or modified sequence opt2 from neuraminidase__InfluenzaA__ACD11079
augaaccccaaccagaagaucaucaccaucggcuccaucugcauggccaucggcaucaucucccucauccuccagaucggcaacaucaucuccaucugggucucccacuccauccagaccggcucccagaaccacaccggcaucugcaaccagcgcaucaucaccuacgagaacuccaccugggucaaccagaccuacgucaacaucuccaacaccaacgucgucgccggcaaggacaccaccuccaugacccucgccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccgucaucaaguacaacggcaucaucaccgagaccaucaaguccuggcgcaagcagauccuccgcacccaggaguccgagugcgucugcgucaacggcuccugcuucaccaucaugaccgacggccccuccgacggccccgccuccuaccgcaucuucaagaucgagaagggcaagaucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaacgucgacggcgccgacggcgucaagggcuucuccuaccgcuacggcaacggcgucuggaucggccgcaccaaguccaacuccucccgcaagggcuucgagaugaucugggaccccaacggcuggaccgacaccgacuccaacuuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaagaccaccaucuggaccuccggcuccuccaucuccuucugcggcgucaacuccgacaccgucaacugguccuggcccgacggcgccgagcucccccucaccaucgacaaguga

SEQ ID NO: 107911 - RNA, 1413 nt, Artificial Sequence; identical to SEQ ID NO: 107542
  derived and/or modified sequence opt2 from neuraminidase__InfluenzaA__ACD56116

SEQ ID NO: 107912 - RNA, 1413 nt, Artificial Sequence; identical to SEQ ID NO: 107542
  derived and/or modified sequence opt2 from neuraminidase__InfluenzaA__ACD56127

SEQ ID NO: 107913 - RNA, 1410 nt, Artificial Sequence; identical to SEQ ID NO: 107396
  derived and/or modified sequence opt2 from neuraminidase__InfluenzaA__ACD56261

SEQ ID NO: 107914 - RNA, 1410 nt, Artificial Sequence
  derived and/or modified sequence opt2 from neuraminidase__InfluenzaA__ACD56272
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107915 - RNA, 1413 nt, Artificial Sequence
  derived and/or modified sequence opt2 from neuraminidase__InfluenzaA__ACD56283
augaaccccaaccagaagaucaucaccaucggcuccaucuccauggccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 107916 - RNA, 1410 nt, Artificial Sequence
  derived and/or modified sequence opt2 from neuraminidase__InfluenzaA__ACD56305
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107917 - RNA, 1410 nt, Artificial Sequence
  derived and/or modified sequence opt2 from neuraminidase__InfluenzaA__ACD56316
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucauggacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaagcgcugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107918 - RNA, 1410 nt, Artificial Sequence
  derived and/or modified sequence opt2 from neuraminidase__InfluenzaA__ACD56327
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccuccaagugccaccaguucgcccucggccagggcaccacccucgagaacaagcacuccaacggcaccaagcacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacggcggccgccucgucgacuccaucgucuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggacucccgcuccggcuacgagaccuucaaggucaucggcggcugguccacccccaacuccaagucccaggucaaccgccaggucaucgucgacuccaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107919 - RNA, 1410 nt, Artificial Sequence
  derived and/or modified sequence opt2 from neuraminidase__InfluenzaA__ACD85190
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccaucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107920 - RNA, 1410 nt, Artificial Sequence
  derived and/or modified sequence opt2 from neuraminidase__InfluenzaA__ACD85201
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucuccuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107921 - RNA, 1410 nt, Artificial Sequence
  derived and/or modified sequence opt2 from neuraminidase__InfluenzaA__ACD85212
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaaggagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107922 - RNA, 1410 nt, Artificial Sequence
  derived and/or modified sequence opt2 from neuraminidase__InfluenzaA__ACD85223
augaaccccaaccagaagaucaucaccaucggcuccgucucccucaccaucgccaccgccugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccaucaucgacaucaacauggaggacuacuccaucgacuccuccuacgucugcuccggccucgucggcgacaccccccgcaacgacgaccgcuccuccaacuccaacugccgcaaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107923 - RNA, 1410 nt, Artificial Sequence
  derived and/or modified sequence opt2 from neuraminidase__InfluenzaA__ACD85234
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccgacggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107924 - RNA, 1410 nt, Artificial Sequence
  derived and/or modified sequence opt2 from neuraminidase__InfluenzaA__ACD85245
augaaccccaaccagaagaucaucaccaucggcuccgucucccucaucaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugcccccgcgucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacgaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107925 - RNA, 1410 nt, Artificial Sequence
  derived and/or modified sequence opt2 from neuraminidase__InfluenzaA__ACD85454
augaaccccaaccagaagaucaucaccaucggcuccgucucccucaccaucuccaccaucggcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107926 - RNA, 1410 nt, Artificial Sequence
  derived and/or modified sequence opt2 from neuraminidase__InfluenzaA__ACD85465
augaaccccaaccagaagaucaucaccaucggcuccgucucccucaccaucuccaccaucggcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107927 - RNA, 1410 nt, Artificial Sequence
  derived and/or modified sequence opt2 from neuraminidase__InfluenzaA__ACD85487
augaaccccaaccagaagaucaucaccaucggcuccgucucccucaucaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107928 - RNA, 1410 nt, Artificial Sequence
  derived and/or modified sequence opt2 from neuraminidase__InfluenzaA__ACD85498
augaaccccaaccagaagaucaucaccaucggcuccgucucccucaucaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107929 - RNA, 1410 nt, Artificial Sequence
  derived and/or modified sequence opt2 from neuraminidase__InfluenzaA__ACD85509
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcucccgcggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107930 - RNA, 1410 nt, Artificial Sequence
  derived and/or modified sequence opt2 from neuraminidase__InfluenzaA__ACD85520
augaaccccaaccagaagaucaucaccaucggcuccgucucccucaucaucuccaccaucggcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107931 - RNA, 1410 nt, Artificial Sequence; identical to SEQ ID NO: 107926
  derived and/or modified sequence opt2 from neuraminidase__InfluenzaA__ACD85553

SEQ ID NO: 107932 - RNA, 1410 nt, Artificial Sequence
  derived and/or modified sequence opt2 from neuraminidase__InfluenzaA__ACD85564
augaaccccaaccagaagaucaucaccaucggcuccgucucccucaucaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaccgcccaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107933 - RNA, 1410 nt, Artificial Sequence
  derived and/or modified sequence opt2 from neuraminidase__InfluenzaA__ACD85575
augaaccccaaccagaagaucaucaccaucggcuccgucucccucaucaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107934 - RNA, 1410 nt, Artificial Sequence
  derived and/or modified sequence opt2 from neuraminidase__InfluenzaA__ACD85586
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccgcggcgucaagggcugggccuucgacgacggcaacgacgucuggaugggccgcaccaucuccgagaagucccgccucggcuacgagaccuucaaggucaucgagggcugguccaaccccaaguccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107935 - RNA, 1410 nt, Artificial Sequence
  derived and/or modified sequence opt2 from neuraminidase__InfluenzaA__ACD93582
augaaccccaaccagaagaucaucaccaucggcuccgucucccucaccaucuccaccaucugcuucuucaugcagaucgccauccucgccaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107936 - RNA, 1410 nt, Artificial Sequence; identical to SEQ ID NO: 106224
  derived and/or modified sequence opt2 from neuraminidase__InfluenzaA__ACF09403

SEQ ID NO: 107937 - RNA, 1410 nt, Artificial Sequence; identical to SEQ ID NO: 107441
  derived and/or modified sequence opt2 from neuraminidase__InfluenzaA__ACF22151

SEQ ID NO: 107938 - RNA, 1410 nt, Artificial Sequence; identical to SEQ ID NO: 105607
  derived and/or modified sequence opt2 from neuraminidase__InfluenzaA__ACF22246

SEQ ID NO: 107939 - RNA, 1410 nt, Artificial Sequence; identical to SEQ ID NO: 105607
  derived and/or modified sequence opt2 from neuraminidase__InfluenzaA__ACF22257

SEQ ID NO: 107940 - RNA, 1410 nt, Artificial Sequence; identical to SEQ ID NO: 105607
  derived and/or modified sequence opt2 from neuraminidase__InfluenzaA__ACF22279

SEQ ID NO: 107941 - RNA, 1410 nt, Artificial Sequence; identical to SEQ ID NO: 105607
  derived and/or modified sequence opt2 from neuraminidase__InfluenzaA__ACF22290

SEQ ID NO: 107942 - RNA, 1410 nt, Artificial Sequence; identical to SEQ ID NO: 105607
  derived and/or modified sequence opt2 from neuraminidase__InfluenzaA__ACF22301

SEQ ID NO: 107943 - RNA, 1410 nt, Artificial Sequence; identical to SEQ ID NO: 105607
  derived and/or modified sequence opt2 from neuraminidase__InfluenzaA__ACF22312

SEQ ID NO: 107944 - RNA, 1410 nt, Artificial Sequence
  derived and/or modified sequence opt2 from neuraminidase__InfluenzaA__ACF22323
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccuacgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107945 - RNA, 1410 nt, Artificial Sequence; identical to SEQ ID NO: 105607
  derived and/or modified sequence opt2 from neuraminidase__InfluenzaA__ACF22334

SEQ ID NO: 107946 - RNA, 1410 nt, Artificial Sequence; identical to SEQ ID NO: 105607
  derived and/or modified sequence opt2 from neuraminidase__InfluenzaA__ACF22367

SEQ ID NO: 107947 - RNA, 1410 nt, Artificial Sequence
  derived and/or modified sequence opt2 from neuraminidase__InfluenzaA__ACF22378
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugcaagaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107948 - RNA, 1410 nt, Artificial Sequence
  derived and/or modified sequence opt2 from neuraminidase__InfluenzaA__ACF22389
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucguccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107949 - RNA, 1410 nt, Artificial Sequence
  derived and/or modified sequence opt2 from neuraminidase__InfluenzaA__ACF22400
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucauggacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107950 - RNA, 1410 nt, Artificial Sequence; identical to SEQ ID NO: 107578
  derived and/or modified sequence opt2 from neuraminidase__InfluenzaA__ACF22411

SEQ ID NO: 107951 - RNA, 1413 nt, Artificial Sequence
  derived and/or modified sequence opt2 from neuraminidase__InfluenzaA__ACF33772
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuucuacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaucgccaacugguccuggcccgacggcgccgagcuccccuucaccaucgacaaguga

SEQ ID NO: 107952 - RNA, 1410 nt, Artificial Sequence
  derived and/or modified sequence opt2 from neuraminidase__InfluenzaA__ACF33778
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcauccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagaacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107953 - RNA, 1410 nt, Artificial Sequence
  derived and/or modified sequence opt2 from neuraminidase__InfluenzaA__ACF33785
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacguccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107954 - RNA, 1413 nt, Artificial Sequence
  derived and/or modified sequence opt2 from neuraminidase__InfluenzaA__ACF33787
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccggcaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccggcaucgccaacugguccuggcccgacggcgccgagcuccccuucaccaucgacaaguga

SEQ ID NO: 107955 - RNA, 1410 nt, Artificial Sequence; identical to SEQ ID NO: 107396
  derived and/or modified sequence opt2 from neuraminidase__InfluenzaA__ACF33798

SEQ ID NO: 107956 - RNA, 1410 nt, Artificial Sequence; identical to SEQ ID NO: 107569
  derived and/or modified sequence opt2 from neuraminidase__InfluenzaA__ACF41672

SEQ ID NO: 107957 - RNA, 1413 nt, Artificial Sequence; identical to SEQ ID NO: 107542
  derived and/or modified sequence opt2 from neuraminidase__InfluenzaA__ACF41683

SEQ ID NO: 107958 - RNA, 1410 nt, Artificial Sequence
  derived and/or modified sequence opt2 from neuraminidase__InfluenzaA__ACF41749
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccggcaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107959 - RNA, 1410 nt, Artificial Sequence
  derived and/or modified sequence opt2 from neuraminidase__InfluenzaA__ACF41760
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccgcggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107960 - RNA, 1410 nt, Artificial Sequence
  derived and/or modified sequence opt2 from neuraminidase__InfluenzaA__ACF41771
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaucaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107961 - RNA, 1410 nt, Artificial Sequence; identical to SEQ ID NO: 105607
  derived and/or modified sequence opt2 from neuraminidase__InfluenzaA__ACF41793

SEQ ID NO: 107962 - RNA, 1410 nt, Artificial Sequence; identical to SEQ ID NO: 105607
  derived and/or modified sequence opt2 from neuraminidase__InfluenzaA__ACF41804

SEQ ID NO: 107963 - RNA, 1410 nt, Artificial Sequence; identical to SEQ ID NO: 105607
  derived and/or modified sequence opt2 from neuraminidase__InfluenzaA__ACF41826

SEQ ID NO: 107964 - RNA, 1365 nt, Artificial Sequence; identical to SEQ ID NO: 107231
  derived and/or modified sequence opt2 from neuraminidase__InfluenzaA__ACF41837

SEQ ID NO: 107965 - RNA, 1413 nt, Artificial Sequence
  derived and/or modified sequence opt2 from neuraminidase__InfluenzaA__ACF41881
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107966 - RNA, 1410 nt, Artificial Sequence; identical to SEQ ID NO: 107441
  derived and/or modified sequence opt2 from neuraminidase__InfluenzaA__ACF41892

SEQ ID NO: 107967 - RNA, 1410 nt, Artificial Sequence; identical to SEQ ID NO: 105839
  derived and/or modified sequence opt2 from neuraminidase__InfluenzaA__ACF41903

SEQ ID NO: 107968 - RNA, 1410 nt, Artificial Sequence
  derived and/or modified sequence opt2 from neuraminidase__InfluenzaA__ACF41914
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccucggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107969 - RNA, 1413 nt, Artificial Sequence
  derived and/or modified sequence opt2 from neuraminidase__InfluenzaA__ACF41925
augaaccccaaccagaagaucaucaccaucggcuccaucuccauggccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuaccgcaucuucaagaucgagaagggcaaggucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccgucaagcaggacgucgucgccaugaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 107970 - RNA, 1413 nt, Artificial Sequence; identical to SEQ ID NO: 107969
  derived and/or modified sequence opt2 from neuraminidase__InfluenzaA__ACF41936

SEQ ID NO: 107971 - RNA, 1410 nt, Artificial Sequence
  derived and/or modified sequence opt2 from neuraminidase__InfluenzaA__ACF54392
augaaccccaaccagaagaucaucaccaucggcuccgucucccucaccaccgccaccgccugcuuccucacccagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgacuccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuucuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107972 - RNA, 1410 nt, Artificial Sequence; identical to SEQ ID NO: 105607
  derived and/or modified sequence opt2 from neuraminidase__InfluenzaA__ACF54403

SEQ ID NO: 107973 - RNA, 1410 nt, Artificial Sequence; identical to SEQ ID NO: 105607
  derived and/or modified sequence opt2 from neuraminidase__InfluenzaA__ACF54414

SEQ ID NO: 107974 - RNA, 1410 nt, Artificial Sequence; identical to SEQ ID NO: 105607
  derived and/or modified sequence opt2 from neuraminidase__InfluenzaA__ACF54425

SEQ ID NO: 107975 - RNA, 1410 nt, Artificial Sequence; identical to SEQ ID NO: 105607
  derived and/or modified sequence opt2 from neuraminidase__InfluenzaA__ACF54436

SEQ ID NO: 107976 - RNA, 1410 nt, Artificial Sequence
  derived and/or modified sequence opt2 from neuraminidase__InfluenzaA__ACF54447
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107977 - RNA, 1410 nt, Artificial Sequence
  derived and/or modified sequence opt2 from neuraminidase__InfluenzaA__ACF54469
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcauggccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 107978 - RNA, 1410 nt, Artificial Sequence; identical to SEQ ID NO: 107272
  derived and/or modified sequence opt2 from neuraminidase__InfluenzaA__ACF54480

SEQ ID NO: 107979 - RNA, 1410 nt, Artificial Sequence
  derived and/or modified sequence opt2 from neuraminidase__InfluenzaA__ACF54502
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcgucuccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107980 - RNA, 1410 nt, Artificial Sequence; identical to SEQ ID NO: 107979
  derived and/or modified sequence opt2 from neuraminidase__InfluenzaA__ACF54513

SEQ ID NO: 107981 - RNA, 1410 nt, Artificial Sequence
  derived and/or modified sequence opt2 from neuraminidase__InfluenzaA__ACF54524
augaaccccaaccagaagaucaucaccaucggcuccgucucccucaccaucgccaccgucugcuucuucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcgucuccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucaacaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 107982 - RNA, 1410 nt, Artificial Sequence
  derived and/or modified sequence opt2 from neuraminidase__InfluenzaA__ACF54535
augaaccccaaccagaagaucaucaccaucggcuccgucucccucaucaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccaagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107983 - RNA, 1410 nt, Artificial Sequence; identical to SEQ ID NO: 105796
  derived and/or modified sequence opt2 from neuraminidase__InfluenzaA__ACF54557

SEQ ID NO: 107984 - RNA, 1410 nt, Artificial Sequence; identical to SEQ ID NO: 107441
  derived and/or modified sequence opt2 from neuraminidase__InfluenzaA__ACF54568

SEQ ID NO: 107985 - RNA, 1410 nt, Artificial Sequence
  derived and/or modified sequence opt2 from neuraminidase__InfluenzaA__ACF54579
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaucaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107986 - RNA, 1362 nt, Artificial Sequence
  derived and/or modified sequence opt2 from neuraminidase__InfluenzaA__ACF54601
augaaccccaaccagaagaucaucaccaucggcuccaucugcauggucgucggcaucaucucccucauccuccagaucggcaacaucaucuccaucuggaucucccacuccauccagaccggcaaccagaaccacaccggcaucugcaaccagggcuccaucaccuacaaggucgucgccggccaggacuccaccuccgucauccucaccggcaacuccucccucugccccauccgcggcugggccauccacuccaaggacaacggcauccgcaucggcuccaagggcgacgucuucgucauccgcgagcccuucaucuccugcucccaccucgagugccgcaccuucuuccucacccagggcgcccuccucaacgacaagcacucccgcggcaccuucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagaacauccuccgcacccaggaguccgagugcaccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuacaagaucggcuacaucugcuccggcgucuucggcgacaacccccgccccaaggacggcaccggcuccugcggccccgucuccgccgacggcgccaacggcgucaagggcuucuccuacaaguacggcaacggcgucuggaucggccgcaccaaguccgacuccucccgccacggcuucgagaugaucugggaccccaacggcuggaccgagaccgacucccgcuucuccaugcgccaggacgucgucgccaugaccgaccgcuccggcuacuccggcuccuucguccagcaccccgagcucaccggccucgacugcaugcgccccugcuucugggucgagcucauccgcggccuccccgaggagaacgccaucuggaccuccggcuccaucaucuccuucugcggcgucaacuccgacaccgucgacugguccuggcccgacggcgccgagcuccccuucaccaucgacaaguga

SEQ ID NO: 107987 - RNA, 1350 nt, Artificial Sequence
  derived and/or modified sequence opt2 from neuraminidase__InfluenzaA__ACG50700
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccaucuccaacaccaacuuccucaccgagaaggccgucgccuccgucacccucgccggcaacuccccccucugccccaucuccggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccuccgaggucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccaccaacggcgccuacggcgucaagggcuucuccuucaaguacggcaacggcgucuggaucggccgcaccaaguccaccaacucccgcuccggcuucgagaugaucugggacuccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 107988 - RNA, 1410 nt, Artificial Sequence; identical to SEQ ID NO: 107569
  derived and/or modified sequence opt2 from neuraminidase__InfluenzaA__ACG70145

SEQ ID NO: 107989 - RNA, 1410 nt, Artificial Sequence; identical to SEQ ID NO: 107396
  derived and/or modified sequence opt2 from neuraminidase__InfluenzaA__ACG70156

SEQ ID NO: 107990 - RNA, 1410 nt, Artificial Sequence
  derived and/or modified sequence opt2 from neuraminidase__InfluenzaA__ACG80407
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcucgccaaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccgcccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107991 - RNA, 1410 nt, Artificial Sequence
  derived and/or modified sequence opt2 from neuraminidase__InfluenzaA__ACG80411
auggacuccaacuccaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccgccggcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacgacggccgccucgucgacggcgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107992 - RNA, 1407 nt, Artificial Sequence
  derived and/or modified sequence opt2 from neuraminidase__InfluenzaA__ACG80421
augaaccccauccagaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccgacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107993 - RNA, 1407 nt, Artificial Sequence
  derived and/or modified sequence opt2 from neuraminidase__InfluenzaA__ACG80427
auggaccccaacuccaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccgacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107994 - RNA, 1410 nt, Artificial Sequence
  derived and/or modified sequence opt2 from neuraminidase__InfluenzaA__ACG80437
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccaacuucaucuacaacggccgccucgucgacuccaucgucuccugguccaaggagaucuuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107995 - RNA, 1407 nt, Artificial Sequence
  derived and/or modified sequence opt2 from neuraminidase__InfluenzaA__ACG80446
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccgacaccgcccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107996 - RNA, 1410 nt, Artificial Sequence
  derived and/or modified sequence opt2 from neuraminidase__InfluenzaA__ACG80455
augaaccccaaccagaagaucaucaccaucggcuccgucuccuucaucaucuccuccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccgcccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacgacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107997 - RNA, 1407 nt, Artificial Sequence; identical to SEQ ID NO: 107995
  derived and/or modified sequence opt2 from neuraminidase__InfluenzaA__ACG80464

SEQ ID NO: 107998 - RNA, 1410 nt, Artificial Sequence
  derived and/or modified sequence opt2 from neuraminidase__InfluenzaA__ACG80473
auggaccccauccagaagaucaucaccaucggcuccgucucccucaccaucuccaccaucugcuucuucaugcagaucgccauccucaucaccaccgucacccuccacuucaagcaguacgaguucaacuccccccccaacaaccagaugaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccgcccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacgacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 107999 - RNA, 1410 nt, Artificial Sequence; identical to SEQ ID NO: 106224
  derived and/or modified sequence opt2 from neuraminidase__InfluenzaA__ACH69559

SEQ ID NO: 108000 - RNA, 1410 nt, Artificial Sequence
  derived and/or modified sequence opt2 from neuraminidase__InfluenzaA__ACH69570
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaacaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108001 - RNA, 1410 nt, Artificial Sequence; identical to SEQ ID NO: 106224
  derived and/or modified sequence opt2 from neuraminidase__InfluenzaA__ACH69581

SEQ ID NO: 108002 - RNA, 1410 nt, Artificial Sequence
  derived and/or modified sequence opt2 from neuraminidase__InfluenzaA__ACH69592
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccagugcuucuacgucgagcucauccgcggccgcaagcaggagaccgagguccucuggaccuccaacuccaucgucgucuucugcggcaccuccggcaccuacggcaccggcuccuggcccgacggcgccgaccucaaccucaugcccaucuga

SEQ ID NO: 108003 - RNA, 1410 nt, Artificial Sequence
  derived and/or modified sequence opt2 from neuraminidase__InfluenzaA__ACH69603
augaaccccaaccagaagaucaucaccaucggcuccgucucccucaccaucgccaccaucugcuuccucaugcagaucgucauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgaccucaaccucaugcccaucuga

SEQ ID NO: 108004 - RNA, 1410 nt, Artificial Sequence
  derived and/or modified sequence opt2 from neuraminidase__InfluenzaA__ACH69614
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgaccucaaccucaugcccaucuga

SEQ ID NO: 108005 - RNA, 1413 nt, Artificial Sequence
  derived and/or modified sequence opt2 from neuraminidase__InfluenzaA__ACI22525
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108006 - RNA, 1413 nt, Artificial Sequence; identical to SEQ ID NO: 108005
  derived and/or modified sequence opt2 from neuraminidase__InfluenzaA__ACI22526

SEQ ID NO: 108007 - RNA, 1413 nt, Artificial Sequence; identical to SEQ ID NO: 108005
  derived and/or modified sequence opt2 from neuraminidase__InfluenzaA__ACI22527

SEQ ID NO: 108008 - RNA, 1413 nt, Artificial Sequence; identical to SEQ ID NO: 108005
  derived and/or modified sequence opt2 from neuraminidase__InfluenzaA__ACI22528

SEQ ID NO: 108009 - RNA, 1413 nt, Artificial Sequence; identical to SEQ ID NO: 108005
  derived and/or modified sequence opt2 from neuraminidase__InfluenzaA__ACI22529

SEQ ID NO: 108010 - RNA, 1413 nt, Artificial Sequence; identical to SEQ ID NO: 108005
  derived and/or modified sequence opt2 from neuraminidase__InfluenzaA__ACI22530

SEQ ID NO: 108011 - RNA, 1413 nt, Artificial Sequence
  derived and/or modified sequence opt2 from neuraminidase__InfluenzaA__ACI22532
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108012 - RNA, 1413 nt, Artificial Sequence; identical to SEQ ID NO: 108011
  derived and/or modified sequence opt2 from neuraminidase__InfluenzaA__ACI22533

SEQ ID NO: 108013 - RNA, 1413 nt, Artificial Sequence; identical to SEQ ID NO: 108005
  derived and/or modified sequence opt2 from neuraminidase__InfluenzaA__ACI22534

SEQ ID NO: 108014 - RNA, 1410 nt, Artificial Sequence
  derived and/or modified sequence opt2 from neuraminidase__InfluenzaA__ACI25727
augaaccccaaccagaagaucaucaccaucggcuccgucucccucaccaucgccaccgucugcuuccucaugcagaucgccauccucgucaccaccgucacccuccacuucaagcagcacgagugcaacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 108015 - RNA, 1410 nt, Artificial Sequence
  derived and/or modified sequence opt2 from neuraminidase__InfluenzaA__ACI25749
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcacaucuga

SEQ ID NO: 108016 - RNA, 1410 nt, Artificial Sequence; identical to SEQ ID NO: 108015
  derived and/or modified sequence opt2 from neuraminidase__InfluenzaA__ACI25760

SEQ ID NO: 108017 - RNA, 1410 nt, Artificial Sequence; identical to SEQ ID NO: 108015
  derived and/or modified sequence opt2 from neuraminidase__InfluenzaA__ACI25771

SEQ ID NO: 108018 - RNA, 1410 nt, Artificial Sequence; identical to SEQ ID NO: 105607
  derived and/or modified sequence opt2 from neuraminidase__InfluenzaA__ACI25782

SEQ ID NO: 108019 - RNA, 1410 nt, Artificial Sequence
  derived and/or modified sequence opt2 from neuraminidase__InfluenzaA__ACI25793
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgucggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 108020 - RNA, 1410 nt, Artificial Sequence
  derived and/or modified sequence opt2 from neuraminidase__InfluenzaA__ACI25804
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgaccaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 108021 - RNA, 1410 nt, Artificial Sequence; identical to SEQ ID NO: 107979
  derived and/or modified sequence opt2 from neuraminidase__InfluenzaA__ACI26277

SEQ ID NO: 108022 - RNA, 1410 nt, Artificial Sequence; identical to SEQ ID NO: 105839
  derived and/or modified sequence opt2 from neuraminidase__InfluenzaA__ACI26299

SEQ ID NO: 108023 - RNA, 1410 nt, Artificial Sequence
  derived and/or modified sequence opt2 from neuraminidase__InfluenzaA__ACI26321
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaccgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108024 - RNA, 1410 nt, Artificial Sequence
  derived and/or modified sequence opt2 from neuraminidase__InfluenzaA__ACI26354
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108025 - RNA, 1410 nt, Artificial Sequence
  derived and/or modified sequence opt2 from neuraminidase__InfluenzaA__ACI26365
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucaccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcguccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108026 - RNA, 1410 nt, Artificial Sequence; identical to SEQ ID NO: 108024
  derived and/or modified sequence opt2 from neuraminidase__InfluenzaA__ACI26376

SEQ ID NO: 108027 - RNA, 1410 nt, Artificial Sequence; identical to SEQ ID NO: 107916
  derived and/or modified sequence opt2 from neuraminidase__InfluenzaA__ACI26387

SEQ ID NO: 108028 - RNA, 1410 nt, Artificial Sequence; identical to SEQ ID NO: 107928
  derived and/or modified sequence opt2 from neuraminidase__InfluenzaA__ACI26420

SEQ ID NO: 108029 - RNA, 1410 nt, Artificial Sequence; identical to SEQ ID NO: 105839
  derived and/or modified sequence opt2 from neuraminidase__InfluenzaA__ACI26431

SEQ ID NO: 108030 - RNA, 1413 nt, Artificial Sequence
  derived and/or modified sequence opt2 from neuraminidase__InfluenzaA__ACI26442
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccaucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108031 - RNA, 1413 nt, Artificial Sequence; identical to SEQ ID NO: 108030
  derived and/or modified sequence opt2 from neuraminidase__InfluenzaA__ACI26453

SEQ ID NO: 108032 - RNA, 1410 nt, Artificial Sequence
  derived and/or modified sequence opt2 from neuraminidase__InfluenzaA__ACI26464
augaaccccaaccagaagaucaucaccaucggcuccgucucccucaccaucuccaccaucugcuucuucaugcagaucgccauccucaucgccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaccgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108033 - RNA, 1410 nt, Artificial Sequence; identical to SEQ ID NO: 108023
  derived and/or modified sequence opt2 from neuraminidase__InfluenzaA__ACI26475

SEQ ID NO: 108034 - RNA, 1410 nt, Artificial Sequence; identical to SEQ ID NO: 108024
  derived and/or modified sequence opt2 from neuraminidase__InfluenzaA__ACI26486

SEQ ID NO: 108035 - RNA, 1410 nt, Artificial Sequence; identical to SEQ ID NO: 108024
  derived and/or modified sequence opt2 from neuraminidase__InfluenzaA__ACI26497

SEQ ID NO: 108036 - RNA, 1410 nt, Artificial Sequence; identical to SEQ ID NO: 108024
  derived and/or modified sequence opt2 from neuraminidase__InfluenzaA__ACI26508

SEQ ID NO: 108037 - RNA, 1410 nt, Artificial Sequence
  derived and/or modified sequence opt2 from neuraminidase__InfluenzaA__ACI26519
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 108038 - RNA, 1410 nt, Artificial Sequence; identical to SEQ ID NO: 108024
  derived and/or modified sequence opt2 from neuraminidase__InfluenzaA__ACI26530

SEQ ID NO: 108039 - RNA, 1410 nt, Artificial Sequence; identical to SEQ ID NO: 108024
  derived and/or modified sequence opt2 from neuraminidase__InfluenzaA__ACI26541

SEQ ID NO: 108040 - RNA, 1410 nt, Artificial Sequence
  derived and/or modified sequence opt2 from neuraminidase__InfluenzaA__ACI26552
augaaccccaaccagaagaucaucaccaucggcuccgucucccucaccaucgccaccaugugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga
